(12) United States Patent
Guyon et al.

(10) Patent No.: US 7,884,073 B2
(45) Date of Patent: Feb. 8, 2011

(54) MODIFIED GROWTH HORMONE

(75) Inventors: Thierry Guyon, Palaiseau (FR); Gilles Borrelly, Epinay-sous-Senart (FR); Lila Drittanti, Vigneux-sur-Seine (FR); Manuel Vega, Vigneux-sur-Seine (FR)

(73) Assignee: HanAll BioPharma Co., Ltd., Daejeon, Seoul (KR)

( * ) Notice: Subject to any disclaimer, the term of this patent is extended or adjusted under 35 U.S.C. 154(b) by 428 days.

(21) Appl. No.: 11/476,173

(22) Filed: Jun. 26, 2006

(65) Prior Publication Data

US 2006/0247170 A1 Nov. 2, 2006
US 2008/0026993 A9 Jan. 31, 2008

Related U.S. Application Data

(63) Continuation of application No. 11/267,871, filed on Nov. 3, 2005.

(60) Provisional application No. 60/625,652, filed on Nov. 4, 2004, provisional application No. 60/706,697, filed on Aug. 8, 2005.

(51) Int. Cl.
*A61K 38/27* (2006.01)
*C07K 14/61* (2006.01)
(52) U.S. Cl. .............................. 514/12; 514/2; 530/399
(58) Field of Classification Search ........................ None
See application file for complete search history.

(56) References Cited

U.S. PATENT DOCUMENTS

| | | | |
|---|---|---|---|
| 4,044,126 A | 8/1977 | Cook et al. |
| 4,302,386 A | 11/1981 | Stevens |
| 4,342,832 A | 8/1982 | Goeddel et al. |
| 4,363,877 A | 12/1982 | Goodman et al. |
| 4,364,923 A | 12/1982 | Cook et al. |
| 4,414,209 A | 11/1983 | Cook et al. |
| 4,446,235 A | 5/1984 | Seeburg ................ 435/91.51 |
| 4,522,811 A | 6/1985 | Eppstein et al. |
| 4,601,980 A | 7/1986 | Goeddel et al. |
| 4,604,359 A | 8/1986 | Goeddel et al. |
| 4,634,677 A | 1/1987 | Goeddel et al. |
| 4,658,021 A | 4/1987 | Goeddel et al. |
| 4,665,160 A | 5/1987 | Seeburg |
| 4,670,393 A | 6/1987 | Seeburg |
| 4,747,825 A | 5/1988 | Linkie et al. |
| 4,755,465 A | 7/1988 | Gray et al. |
| 4,775,622 A | 10/1988 | Hitzeman et al. |
| 4,831,120 A | 5/1989 | Aviv et al. |
| 4,859,600 A | 8/1989 | Gray et al. |
| 4,871,835 A | 10/1989 | Aviv et al. |
| 4,892,538 A | 1/1990 | Aebischer et al. |
| 4,898,830 A | 2/1990 | Goeddel et al. |
| 4,910,021 A | 3/1990 | Davis et al. |
| 4,988,798 A | 1/1991 | Blum et al. |
| 4,997,916 A | 3/1991 | Aviv et al. |
| 5,033,352 A | 7/1991 | Kellogg et al. |
| 5,047,511 A | 9/1991 | Mehrotra |
| 5,052,558 A | 10/1991 | Carter |
| 5,068,317 A | 11/1991 | Becker et al. |
| 5,079,230 A | 1/1992 | Randawa et al. |
| 5,079,345 A | 1/1992 | Becker et al. |
| 5,089,473 A | 2/1992 | Krivi et al. |
| 5,096,815 A | 3/1992 | Ladner et al. |
| 5,101,018 A | 3/1992 | Mehrotra et al. |
| 5,109,121 A | 4/1992 | Blum et al. |
| 5,130,422 A | 7/1992 | Krivi et al. |
| 5,198,361 A | 3/1993 | Aviv et al. |
| 5,221,619 A | 6/1993 | Itakura et al. |
| 5,223,409 A | 6/1993 | Ladner et al. |
| 5,256,546 A | 10/1993 | Aviv et al. |
| 5,283,187 A | 2/1994 | Aebischer et al. |
| 5,310,882 A | 5/1994 | Chaleff |
| 5,323,907 A | 6/1994 | Kalvelage |
| 5,350,836 A | 9/1994 | Kopchick et al. |
| 5,424,199 A | 6/1995 | Goeddel et al. |
| 5,424,289 A | 6/1995 | Yang et al. |
| 5,534,617 A | 7/1996 | Cunningham et al. |
| 5,548,068 A | 8/1996 | Fischer et al. |
| 5,631,227 A | 5/1997 | Harbour et al. |
| 5,633,352 A | 5/1997 | Dalboge et al. |
| 5,637,495 A | 6/1997 | Gorecki et al. |
| 5,663,305 A | 9/1997 | Lehrman et al. |
| 5,670,371 A | 9/1997 | Aviv et al. |
| 5,681,809 A | 10/1997 | Kopchick et al. |
| 5,688,666 A | 11/1997 | Bass et al. |
| 5,698,418 A | 12/1997 | Brunner et al. |
| 5,750,373 A | 5/1998 | Garrard et al. |
| 5,834,598 A | 11/1998 | Lowman et al. |
| 5,840,570 A | 11/1998 | Berka et al. |
| 5,849,535 A | 12/1998 | Cunningham et al. |
| 5,849,694 A | 12/1998 | Synenki et al. |
| 5,854,026 A | 12/1998 | Cunningham et al. |
| 5,891,840 A | 4/1999 | Cady et al. |
| 5,925,565 A | 7/1999 | Berlioz et al. |
| 5,951,972 A | 9/1999 | Daley et al. |
| 5,958,879 A | 9/1999 | Kopchick et al. |
| 5,962,411 A | 10/1999 | Rosen et al. |
| 6,004,931 A | 12/1999 | Cunningham et al. |
| 6,010,999 A | 1/2000 | Daley et al. |

(Continued)

FOREIGN PATENT DOCUMENTS

CN 1162600 A 10/1997

(Continued)

OTHER PUBLICATIONS

Wells (Biochem. 29 (37): 8509-8517, 1990).*

(Continued)

*Primary Examiner*—Christine J Saoud
(74) *Attorney, Agent, or Firm*—K&L Gates LLP; Stephanie Seidman

(57) ABSTRACT

Provided are modified growth hormone polypeptides, nucleic acid molecules encoding modified growth hormone polypeptides and methods of generating modified growth hormone polypeptides. Also provided are methods of treatment using modified growth hormone polypeptides.

32 Claims, 3 Drawing Sheets

U.S. PATENT DOCUMENTS

| | | | |
|---|---|---|---|
| 6,013,478 A | 1/2000 | Wells et al. ............... 435/69.1 |
| 6,022,711 A | 2/2000 | Cunningham et al. |
| 6,054,291 A | 4/2000 | Gorecki et al. |
| 6,057,292 A | 5/2000 | Cunningham et al. |
| 6,136,563 A | 10/2000 | Cunningham et al. |
| 6,143,523 A | 11/2000 | Cunningham et al. |
| 6,171,820 B1 | 1/2001 | Short |
| 6,238,915 B1 | 5/2001 | Chihara |
| 6,287,806 B1 | 9/2001 | Nishimura et al. |
| 6,344,213 B1 | 2/2002 | Leone-Bay et al. |
| 6,399,565 B1 | 6/2002 | Asada et al. |
| 6,417,237 B1 | 7/2002 | Dadey et al. ............... 514/937 |
| 6,451,561 B1 | 9/2002 | Wells et al. |
| 6,509,171 B1 | 1/2003 | Berka et al. |
| 6,566,328 B1 | 5/2003 | Rosen et al. |
| 6,566,329 B1 | 5/2003 | Meyn et al. |
| 6,583,115 B1 | 6/2003 | Kopchick et al. |
| 6,608,183 B1 | 8/2003 | Cox, III |
| 6,688,666 B2 | 2/2004 | Neale et al. |
| 6,737,407 B1 | 5/2004 | Ng et al. |
| 6,753,165 B1 | 6/2004 | Cox et al. |
| 6,780,613 B1 | 8/2004 | Wells et al. |
| 6,787,336 B1 | 9/2004 | Kopchick et al. |
| 6,800,740 B1 | 10/2004 | Cunninghamm et al. |
| 6,828,305 B2 | 12/2004 | Ekwuribe et al. |
| 6,936,440 B1 | 8/2005 | Cunninghamm et al. |
| 6,946,265 B1 | 9/2005 | Filikov et al. |
| 7,271,150 B2 | 9/2007 | Loh et al. |
| 7,300,920 B2 | 11/2007 | Weiner et al. |
| 7,338,933 B2 | 3/2008 | DeFrees et al. |
| 7,611,700 B2 | 11/2009 | Gantier et al. ............ 424/85.7 |
| 7,647,184 B2 | 1/2010 | Vega et al. .................. 702/19 |
| 7,650,243 B2 | 1/2010 | Gantier et al. ............... 702/19 |
| 2002/0008158 A1 | 1/2002 | Kuzuyama |
| 2002/0081605 A1 | 6/2002 | Cooper et al. |
| 2003/0129203 A1 | 7/2003 | Vega et al. |
| 2003/0129584 A1 | 7/2003 | Vega |
| 2003/0134351 A1 | 7/2003 | Vega et al. |
| 2003/0153003 A1 | 8/2003 | Wells et al. |
| 2003/0170679 A1 | 9/2003 | Wood et al. |
| 2003/0175694 A1 | 9/2003 | Vega |
| 2003/0224404 A1 | 12/2003 | Vega et al. |
| 2004/0127417 A1 | 7/2004 | Finn |
| 2004/0132977 A1 | 7/2004 | Gantier et al. |
| 2004/0137510 A1 | 7/2004 | Cooper et al. |
| 2004/0142870 A1 | 7/2004 | Finn |
| 2004/0158046 A1 | 8/2004 | Loh et al. |
| 2005/0020494 A1 | 1/2005 | Carr et al. |
| 2005/0026834 A1 | 2/2005 | Cox et al. |
| 2005/0123558 A1 | 6/2005 | Ross et al. |
| 2005/0130150 A1 | 6/2005 | Cooper et al. |
| 2005/0170404 A1 | 8/2005 | Cho et al. |
| 2005/0187160 A1 | 8/2005 | Cox et al. |
| 2005/0202438 A1 | 9/2005 | Gantier et al. |
| 2005/0220762 A1 | 10/2005 | Cho et al. |
| 2005/0233417 A1 | 10/2005 | Cooper et al. |
| 2005/0250678 A1 | 11/2005 | DeFrees et al. |
| 2006/0008872 A1 | 1/2006 | Chung et al. |
| 2006/0020116 A1 | 1/2006 | Gantier et al. |
| 2006/0020396 A1 | 1/2006 | Gantier et al. |
| 2006/0115874 A1 | 6/2006 | Garrard et al. |
| 2006/0183197 A1 | 8/2006 | Andersen et al. |
| 2006/0195268 A1 | 8/2006 | Vega |
| 2006/0247170 A1 | 11/2006 | Guyon et al. |
| 2006/0251619 A1 | 11/2006 | Borrelly et al. |
| 2007/0172459 A1 | 7/2007 | Gantier et al. ............. 424/85.5 |
| 2007/0224665 A1 | 9/2007 | Gantier et al. ............ 435/69.51 |
| 2007/0249532 A9 | 10/2007 | Guyon et al. .................. 514/12 |
| 2007/0254838 A1 | 11/2007 | Gantier et al. .................. 514/12 |
| 2008/0003202 A1 | 1/2008 | Guyon et al. ............. 424/85.6 |
| 2008/0038224 A1 | 2/2008 | Guyon et al. ............. 424/85.6 |
| 2008/0038717 A1 | 2/2008 | Garrard et al. |
| 2008/0075672 A1 | 3/2008 | Gantier et al. ................ 424/45 |
| 2008/0102115 A1 | 5/2008 | Oyhenart et al. ........... 424/457 |
| 2008/0108791 A1 | 5/2008 | Cho et al. |
| 2008/0159977 A1 | 7/2008 | Gantier et al. ............. 424/85.1 |
| 2008/0194477 A1 | 8/2008 | Gantier et al. ................. 514/12 |
| 2008/0260820 A1 | 10/2008 | Borrelly et al. ............. 424/463 |
| 2008/0274081 A9 | 11/2008 | Gantier et al. ............. 424/85.5 |
| 2009/0053147 A1 | 2/2009 | Gantier et al. ................ 424/45 |
| 2009/0123974 A1 | 5/2009 | Gantier et al. ............ 435/69.51 |
| 2009/0131318 A1 | 5/2009 | Gantier et al. ................. 514/12 |
| 2009/0238789 A1 | 9/2009 | Guyon et al. .............. 424/85.5 |

FOREIGN PATENT DOCUMENTS

| | | |
|---|---|---|
| EP | 0240224 | 10/1987 |
| EP | 355460 | 2/1990 |
| EP | 397834 | 11/1990 |
| EP | 429490 | 6/1991 |
| EP | 0131843 | 9/1991 |
| EP | 477198 | 4/1992 |
| EP | 488279 | 6/1992 |
| EP | 0691406 | 1/1996 |
| EP | 691406 | 1/1996 |
| EP | 0319049 | 4/1996 |
| EP | 319049 | 4/1996 |
| EP | 534568 | 5/1996 |
| EP | 458064 | 2/1998 |
| EP | 0496973 | 2/1998 |
| EP | 496973 | 2/1998 |
| EP | 556171 | 8/2000 |
| EP | 0790305 | 4/2002 |
| EP | 1284987 | 7/2007 |
| EP | 1012184 | 10/2007 |
| FR | 2802645 | 6/2001 |
| JP | 11-092499 | 4/1999 |
| WO | WO90/00192 | 1/1990 |
| WO | WO90/02758 | 3/1990 |
| WO | WO90/04788 | 5/1990 |
| WO | WO90/08823 | 8/1990 |
| WO | WO90/15876 | 12/1990 |
| WO | WO91/05853 | 5/1991 |
| WO | WO91/10678 | 7/1991 |
| WO | WO92/01789 | 2/1992 |
| WO | WO92/03478 | 3/1992 |
| WO | WO92/09690 | 6/1992 |
| WO | WO92/19736 | 11/1992 |
| WO | WO94/10200 | 5/1994 |
| WO | WO96/40203 | 12/1996 |
| WO | WO 97/11178 | 3/1997 |
| WO | WO99/03887 | 1/1999 |
| WO | 99/11764 | 3/1999 |
| WO | WO00/15664 | 3/2000 |
| WO | WO00/42175 | 7/2000 |
| WO | 01/25438 | 4/2001 |
| WO | 01/32711 | 5/2001 |
| WO | 01/44809 | 6/2001 |
| WO | 01/61344 | 8/2001 |
| WO | WO01/72119 | 10/2001 |
| WO | 01/86291 | 11/2001 |
| WO | WO01/85993 | 11/2001 |
| WO | WO01/87925 | 11/2001 |
| WO | WO02/055532 | 7/2002 |
| WO | WO02/092619 | 11/2002 |
| WO | 03/018820 | 3/2003 |
| WO | 03/023032 | 3/2003 |
| WO | WO03/020761 | 3/2003 |
| WO | WO03/042226 | 5/2003 |
| WO | WO03/070765 | 8/2003 |
| WO | 2004/022593 | 3/2004 |
| WO | 2004/022747 | 3/2004 |
| WO | 2004/103275 | 12/2004 |
| WO | WO2005/074546 | 8/2005 |

| WO | WO2005/074650 | 8/2005 |
| WO | WO2005/079838 | 9/2005 |
| WO | 2006/024547 | 3/2006 |
| WO | 2006/048777 | 5/2006 |
| WO | 2006/120580 | 11/2006 |
| WO | 2007/110230 | 10/2007 |
| WO | 2008/065372 | 6/2008 |
| WO | 2009/152944 | 12/2009 |

OTHER PUBLICATIONS

Martin, P., "Beyond the Next Generation of Therapeutic proteins," Oct. 2006 .biotech-online.com/artimg/a20062123243425.PDF (accessed on Jan. 11, 2007) (3 pages).

Abdel-Meguid et al. "Three-dimensional structure of a genetically engineered variant of porcine growth hormone," Proc. Natl. Acad. Sci. USA 84: 6434-37 (1987).

Adamapolous et al. "Effects of growth hormone on circulating cytokine network, and left ventricular contractile performance and geometry in patients with idiopathic dilated cardiomyopathy," Eur. Heart J. 24(24): 2186-96 (2003).

Alam et al. "Expression and purification of a mutant human growth hormone that is resistant to proteolytic cleavage by thrombin, plasmin and human plasma in vitro," Journal of Biotechnology 65: 183-190 (1998).

Albertsson-Wikland et al. "Daily subcutaneous administration of human growth hormone in growth hormone deficient children," Acta. Paediatr. Scand. 75: 89-97 (1986).

Ascoli et al. "Adenohypophyseal hormones and their hypothalamic releasing factors," in *Goodman & Gilman's The Pharmacological Basis of Therapeutics*, Hardman et al. (Eds.), New York: McGraw-Hill, pp. 1363-1382 (1996).

Atkinson et al. "A high-throughput hybridizaiton method for titer determination of viuses and gene therapy vectors" Nucleic acids research 26:2821-2823 (1998).

Atschul, et al. "Basic Local Alignment Search Tool," J. Molec. Biol. 215: 403-410 (1990).

Attanasio et al. "Consensus guidelines for the diagnosis and treatment of adults with growth hormone deficiency: Summary statement of the Growth Hormone Research Society Workshop on Adults Growth Hormone Deficiency" J. Clin. Endocrinol. Metab. 83: 379-381 (1998).

Balk et al. "Biology of prostate-specific antigen," Journal of Clinical Oncology, 21(2):383-391, (2003).

Baxter et al. "High molecular weight insulin-like growth factor binding protein complex. Purification and properties of the acid-labile subunit from human serum." J. Biol. Chem. 264: 11843-11848 (1989).

Behncken et al. "Aspartate 171 is the major primate-specific determinant of human growth hormone. Engineering porcine growth hormone to activate the human receptor," the Journal of Biological Chemistry, 272(43):27077-277083, (1997).

Bellini et al. "In vivo bioassay for the potency determination of human growth hormone in dwarf "little" mice." Endocrinology 132: 2051-2055(1993).

Bennet et al. "A randomized, double-blind, placebo-controlled study of growth hormone in the treatment of fibromyalgia." Am. J. Med. 104(3): 227-31 (1998).

bioinfo.hku.hk/services/analyseq/cgi-bin/proteol_in.pl (accessed on Jan. 10, 2006), 2 pgs.

Boguszewski, C.L., et al. "Cloning of two novel growth hormone transcripts expressed in human placenta," The Journal of Clinical Endocrinology and Metabolism, Aug;83(8):2878-2885, (1998).

Bonello et al. "Effects of growth hormone and estrogen on T lymphocytes in older women" J. Am. Geriatr. Soc. 44(9): 1038-42 (1996).

Brems et al. "Stabilization of an associated folding intermediate of bovine growth hormone by site-directed mutagenesis," Proceedings of the National Academy of Sciences, 85(10):3367-3371, (1988).

Brook et al. "The somatotropic axis in puberty." Endocrinol. Metab. Clin. North Am. 21: 767-782 (1992).

Carillo et al. "The Multiple Sequence Alignment Problem in Biology," Siam J. Applied Math 48: 1073 (1988).

Charbord et al. "Normal human granulo monocytic bone marrow progenitor cells responsiveness to colony stimulating activity" Nouvelle Revue Francaise D'Hematologie, 22:357-370 (1980).

Chiang et al. "In vivo genetic analysis of bacterial virulence," Annu. Rev. Microbiol. 53: 129-154 (1999).

Corpas et al. "Human growth hormone and human aging." Endocr Rev 14: 20-39 (1993).

Davis et al. "High throughput method for creating and screening recombinant adenoviruses" Gene Therapy 5:1148-1152 (1998).

Dayhoff et al. "A Model of Evolutionary Change in Proteins," Atlas of Protein Sequence and Structure, 5(3): 345-352, (1978).

Dery et al. "Proteinase-activated receptors: novel mechanisms of signaling by serine proteases," The American Journal of Physiology, 274(6 Pt 1):C1429-1452, (1998).

Devereux et al. "A comprehensive set of sequence analysis programs for the VAX." Nucleic Acids Research 12(I): 387-395 (1984).

Drittanti et al. "High throughput production, screening and analysis of adeno-associated viral vectors." Gene Therapy 7(11) pp. 924-929 (2000).

Eppard et al. "Pharmacokinetic and galactopoietic response to recombinant variants of bovine growth hormone," Journal of Endocrinology, 139(3):441-450, (1993).

Evans et al. "The purification of the anterior pituitary growth hormone by fractionation with ammonium sulfate," Endocrinology 22: 483-492 (1938).

Feng et al. "Aligning amino acid sequences: comparison of commonly used methods." J. Mol. Evol., 21: 112-125, (1985).

Filikov et al. "Computational stabilization of human growth hormone," Protein Science, 11(6):1452-1461, (2002).

Fitch, "An improved method of testing for evolutionary homology," J. Mol. Biol., 16: 9-16 (1966).

GenBank Accession No. NP_000506.2 (Accessed on Dec. 16, 2005), 17 pgs.

GenBank Accession No. NP_002050.1 (Accessed on Dec. 16, 2005), 5 pgs.

Gibrat et al "Surprising similarities in structure comparison" Curr. Opinion in Structural Biology 6(3): 377-385 (1996).

Gonnet et al. "Exhaustive matching of the entire protein sequence database," Science, 256: 1443-1445 (1992).

Grantham "Amino acid difference formula to help explain protein evolution." Science, 185: 862-864 (1974).

Greespan et al." Bioassay of hypophyseal growth hormone; the tibia test" Endocrinology 45: 455-463 (1949).

Gribskov et al. "Sigma factors from *E. coli*, *B. subtilis*, phage SP01, and phage T4 are homologous proteins" Nucl. Acids Res. 14: 6745-6763 (1986).

Groesbeck et al. "Highly improved precision of the hypophysectomized female rat body weight gain bioassay for growth hormone by increased frequency of injections, avoidance of antibody formation, and other simple modifications." Endocrinology 120: 2582-2590 (1987).

Hardin "GH improves growth and clinical status in children with cystic fibrosis—a review of published studies." Eur. J. Endocrinol. 151(Suppl 1): S81-85 (2004).

Hart et al. "Attenuation of posttraumatic muscle catabolism and osteopenia by long-term growth hormone therapy." Ann. Surg. 233(6): 827-34 (2001).

Henikoff et al. "Amino acid substitution matrices from protein blocks." Proc. Natl. Acad. Sci. USA, 89: 10915-10919 (1992).

Holm et al. "Mapping the protein Universe" Science 273(2):595-602 (1996).

Igout et al. "Purification and biochemical characterization of recombinant human placental growth hormone produced in *Escherichia coli*," The Biochemical Jourrnal, 295 ( Pt 3):719-724, (1993).

Ishikawa et al. "A novel specific bioassay for serum human growth hormone," Journal of Clinical Endocrinology & Metabolism 85(11): 4274-4279 (2000).

IUPAC-IUB Commission on Biochemical Nomenclature Biochem. 11: 942-944 (1972).

IUPAC-IUB Commission on Biochemical Nomenclature, Biochem. 11: 1726 (1972).

Johnson et al. "A structural basis for sequence comparisons. An evaluation of scoring methodologies." J. Mol. Biol., 233: 716-738 (1993).

Jones et al. "The rapid generation of mutation data matrices from protein sequences." Comput. Appl. Biosci., 8: 275-282 (1992).

Kechli et al. "Expression of the human immunodeficiency virus type 1 primer binding sequence inhibits HIV-1 replication." Hum. Gene Ther., 9(4): 587-590 (1998).

Ketner et al. "Efficient manipulation of the human adenovirus genome as an infectious yeast artificial chromosome clone." Proc. Natl. Acad. Sci. USA 91: 6186-6190 (1994).

Khalizzadeh et al. " Process development for production of recombinant human interferon-gamma expressed in *Escherichia coli*." J. Ind. Microbiol. Biotechnol. 31(2): 63-69 (2004).

Kim & Moon, "Purification and Characterization of Intracellular and Extracellular Inulase from Kluyveromyces marxiaus," J. Korean Agricultural Chemical Society. 30:169-178 (1987).

Kotzmann et al. "Effects of 12 months of recombinant growth hormone therapy on parameters of bone metabolism and bone mineral density in patients on chronic hemodialysis." Journal of Nephrology 17(1): 87-94 (2004).

Kruyt et al. "Cytoplasmic localization of a functionally active Fanconi anemia group A-green fluorescent protein chimera in human 293 cells." Blood 90: 3288-3295 (1997).

Kuhn "Structural basis for the positional specificity of lipoxygenases" Prostaglandins and other lipid mediators 62(3): 255-270 (2000).

Kupfer et al. "Enhancement of the anabolic effects of growth hormone and insulin-like growth factor I by use of both agents simultaneously." J. Clin. Invest. 91: 391-396 (1993).

Lesniak et al. "Human growth hormone radioreceptor assay using cultured human lymphocytes," Nature: new biology, 241(105):20-22 (1973).

Lewerenz et al. "Shared receptor components but distinct complexes for alpha and beta interferons" J. Mol. Biol. 282(3) pp. 585-599 (1998).

Lindenbaum et al. "A mammalian artificial chromosome engineering system (ACE System) applicable to biopharmaceutical protein production," Nucleic Acids Res. 32(21): E172 (2004).

Lowman and Wells "Affinity maturation of human growth hormone by monovalent phage display," Journal of Molecular Biology, 234(3):564-578, (1993).

Luo et al. "Effects of recombinant human growth hormone on remnant liver after hepatectomy in hepatocellular carcinoma with cirrhosis." World J Gastroenterol. 10(9): 1292-1296 (2004).

MacGillivray et al. "Current Dosing of Growth Hormone in Children With Growth Hormone Deficiency: How Physiologic?" Pediatrics 102: 527-530 (1998).

Manetti et al. "Design and realization of a tailor-made enzyme to modify the molecular recognition of 2-arylpropionic esters by Candida rugosa lipase" Biochem. Biophys. Acta 1543(1):146-158 (2000).

Marx et al. "Bioassay of the growth hormone of the anterior pituitary," Endocrinology 30(1): 1-10 (1942).

Mathews et al. "Regulation of insulin-like growth factor I gene expression by growth hormone," Proc. Natl. Acad. Sci. USA 83: 9343-9347 (1986).

Mayfield et al. "Expression and assembly of a fully active antibody in algae,". PNAS 100(2):438-442 (2003).

McLachlan "Tests for comparing related amino-acid sequences. Cytochrome c and cytochrome c 551." J. Mol. Biol., 61: 409-424 (1971).

Media Release: "Serono and Nautilus Biotech Sign Worldwide Agreement to Develop and Commercialize a Next-Generation Growth Hormone," Geneva, Switzerland and Paris, France—Nov. 15, 1004 .serono.com/content/media/archives2004.html?highLightLeft=archives2004 (accessed on Oct. 17, 2006) (3 pages).

Mittereder et al. "Evaluation of the concentration and bioactivity of adenovirus vectors for gene therapy" J. Virology 70:7498-7509 (1996).

Miyata "Two types of amino acid substitutions in protein evolution." J. Mol. Evol., 12: 219-236 (1979).

Moullier et al. "Comparative binding of wheat germ agglutinin and its succinylated form on lymphocytes" Eur. J. Biochem. 161:197-204 (1986).

Muneta et al. "Large-scale production of porcine mature interleukin-18 (IL-18) in silkworms using a hybrid " J. Vet. Med. Sci. 65(2): 219-23 (2003).

Needleman et al. "A general method applicable to the search for similarities in the amino acid sequence of two proteins" J. Mol. Biol. 48(3): 443-453 (1970).

Nelson et al. "Characterization of diverse viral vector preparations, using a simple and rapid whole-virion dot-blot method" Human Gene Therapy 9:2401-2405 (1998).

Noordam et al. "Growth hormone treatment in children with Noonan's syndrome: four year results of a partly controlled trial." Acta Paediatr. 90(8): 889-894 (2001).

Ovesen et al. "Growth hormone treatment of subfertile males," Fertil Steril. 66(2): 292-298 (1996).

Pearson et al. "Improved tools for biological sequence comparison" Proc. Natl. Acad. Sci. USA 85: 2444 (1988).

Pham et al. "Large-scale transient transfection of serum-free suspension-growing HEK293 EBNA1 cells: peptone additives improve cell growth and transfection efficiency" Biotechnol. Bioeng. 84: 332-42 (2003).

Piehler et al "New Structural and functional aspects of the type I interferon-receptor interaction revealed by comprehensive mutational analysis of the binding interface" J. Biol Chem. 275(51):40425-40433 (2000).

Platis et al. "High yield expression, refolding, and characterization of recombinant interferon $\alpha 2/\alpha 8$ hybrids in *Escherichia coli*" Protein Exp. Purif. 31(2):222-230 (2003).

Rao New scoring matrix for amino acid residue exchanges based on residue characteristic physical parameters. Intl. J. Pept. Protein Res., 29: 276-281 (1987).

Risler "Amino acid substitutions in structurally related proteins. A pattern recognition approach. Determination of a new and efficient scoring matrix." J. Mol. Biol., 204: 1019-1029 (1988).

Ropp et al. "Aequorea green fluorescent protein analysis by flow cytometry." Cytometry 1995, 21, 309-317 (1995).

Rosenfeld et al. "Modulation of homologous receptor concentrations: a sensitive radioassay for human growth hormone in acromegalic, newborn, and stimulated plasma," J. Clin. Endocrinol. Metab. 50: 62-69 (1980).

Rudman et al. "Effects of human growth hormone in men over 60 years old." The New England Journal of Medicine 323(1): 1-6 (1990).

Saha et al. "Growth hormone is effective in the treatment of severe growth retardation in children with juvenile chronic arthritis. Double blind placebo-controlled followup study," J. Rheumatol. 1(7): 1413-1417 (2004).

Salvetti et al. "Factors influencing recombinant adeno-associated virus production" Human Gene Therapy 9:695-706 (1998).

Schumann et al. "Intracellular Ca2+ Inhibits Smooth Muscle 1-Type Ca2+ channels by activation of protein phosphatse type 2B and by direct interaciton with the channel" J. Gen. Phys. 110:503-513 (1997).

Schwartz and Dayhoff (Eds.) *Atlas of Protein Sequence and Structure*, National Biomedical Research Foundation, pp. 353-358 (1979).

Seikaly et al. "The effect of recombinant human growth hormone in children with X-linked hypophosphatemia." Pediatrics. 100(5): 879-84 (1997).

Skoko et al." Expression and characterization of human interferon-betal in the methylotrophic yeast Pichia pastoris" Biotechnol. Appl. Biochem. 38(Pt3): 257-265 (2003).

Slonim et al. "A preliminary study of growth hormone therapy for Crohn's disease." N. Engl. J. Med. 342(22): 1633-1637 (2000).

Smith and Waterman "Comparision of Biosequences," Adv. Appl. Math. 2: 482-489 (1981).

Smith et al. "Single-step purification of polypeptides expressed in *Escherichia coli* as fusions with glutathione S-transferase." Gene, 67: 31-40 (1988).

Stennicke and Salvesen "Catalytic properties of the caspases," Cell Death and Differentiation, 6(11):1054-1059,(1999).

Suhadolnik et al. "Nucleoside antibiotics. I. Biochemical tools for studying the structural requirements for interaction at the catalytic and regulatory sites of ribonucleotide reductase from *Lactobacillus leichmannii*." J. Biol. Chem., 243: 3552-3559 (1969).

Sundstrom et al. "Crystal structure of an antagonist mutant of human growth hormone, G120R, in complex with its receptor at 2.9 A resolution," The Journal of Biological Chemistry, 271(50):32197-32203, (1996).

Tanaka et al. "A new sensitive and specific bioassay for lactogenic hormones: measurement of prolactin and growth hormone in human serum."J. Clin. Endocrinol. Metab. 51: 1058-1063 (1980).

Tokunaga et al. "Synthesis and expression of a human growth hormone (*somatotropin*) gene mutated to change cysteine-165 to alanine," European Journal of Biochemistry, 153(3):445-449, (1985).

Tsushima et al. "Radioreceptor assay for growth hormone," J. Clin. Endocrinol. Metab. 37: 334-337 (1973).

Vance et al. "Growth hormone therapy in adults and children," The New England Journal of Medicine 341(6): 1206-1216 (1999).

Vogelmeier et al. "Use of secretory leukoprotease inhibitor to augment lung antineutrophilelastase activity," Chest, 110(6 Suppl):261S-266S, (1996).

Weiner et al. "Liposome-collagen gel matrix: a novel sustained drug delivery system." J. Pharm. Sci. 74(9): 922-925 (1985).

Weitzman et al. "Recruitment of wild-type and recombinant adeno-associated virus into adenovirus replication centers," J. Virol., 70(3): 1845-1854 (1996).

Yeo et al. "Frailty and the biochemical effects of recombinant human growth hormone in women after surgery for hip fracture."Growth Horm. IGF Res. 13(6): 361-370 (2003).

Zlauddin et al. "Microarrays of cells expressing defined cDNAs," Nature 411: 107-110 (2001).

Media Release: "In vivo studies provide hope for orally available protein therapeutics," Paris, France and Boston, Massachusetts (USA) Apr. 26, 2006 .prnewswire.co.uk/cgi/news/release?id=169343 (accessed on Dec. 6, 2006) (3 pages).

Media Release: "Nautilus Moves its Long-Lasting, High Availability Human Growth Hormone Into Formal Preclinical Development," Paris, France Jan. 9, 2006 .prnewswire.co.uk/cgi/news/release?id=161460 (accessed on Dec. 6, 2006) (2 pages).

de Vos et al., "Human Growth Hormone and Extracellular domain of Its Receptor: Crystal Structure of the Complex" Science 255:306-312 (1992).

Jin et al., "High resolution functional analysis of antibody-antigen interactions," J. Mol: Biol. 226:851-865 (1992).

NCBI protein 1403262B (accessed on Oct. 19, 2006). Found at: http://www.ncbi.nlm.nih.gov/protein/225906, Accession No. 1403262B, Published on Aug. 2, 1996. [2 pages].

NCBI protein 1BP3A (accessed on Oct. 19, 2006). Found at: http://www.ncbi.nlm.nih.gov/protein/6729890?ordinalpos=1&itool=EntrezSystem2.PEntrez.Sequence.Sequence_ResultsPanel.Sequence_RVDocSum, Accession No. 1BP3_A, Published on Aug. 12, 1998. [2 pages].

NCBI protein 1HWHA (accessed on Oct. 19, 2006). Found at: http://www.ncbi.nlm.nih.gov/protein/2781341, Accession No. 1HWH_A, Published on Nov. 13, 1996. [2 pages].

NCBI protein AAT11508 (accessed on Oct.19, 2006). Found at: http://www.ncbi.nlm.nih.gov/protein/47121568, Accession No. AAT11508, Published on May 16, 2004. [2 pages].

NCBI protein AAT11509 (accessed on Oct. 19, 2006). Found at: http://www.ncbi.nlm.nih.gov/protein/47121579, Accession No. AAT11509, Published on May 16, 2004. [2 pages].

NCBI protein CAA23778 (accessed on Oct. 19, 2006). Found at: http://www.ncbi.nlm.nih.gov/protein/31905, Accession No. CAA23778, Published on Dec. 16, 1994. [2 pages].

NCBI protein CAA23779 (accessed on Oct. 19, 2006). Found at: http://www.ncbi.nlm.nih.gov/protein/312406, Accession No. CAA23779, Published on Jun. 30, 2006. [2 pages].

NCBI protein P01241 (Swiss Prot) (accessed on Oct. 19, 2006). Found at: http://www.ncbi.nlm.nih.gov/protein/134703, Accession No. P01241, Published on Oct. 17, 2006. [11 pages].

NCBI protein P58756 (Swiss Prot) (accessed on Oct. 19, 2006). Found at: http://www.ncbi.nlm.nih.gov/protein/20140015, Accession No. P58756, Published on Nov. 28, 2006. [3 pages].

Derwent English Language Abstract. Dialog® File No. 351, Accession No. 9694659 for JP 11-092499. Inventor: Nakajima, Abstract published 2009. [2 pages].

* cited by examiner

FPTIPLSRLFDNAMLRAHRLHQLAFDTYQEFEEAYIP
KEQKYSFLQNPQTSLCFSESIPTPSNREETQQKSNLEL
LRISLLLIQSWLEPVQFLRSVFANSLVYGASDSNVYD
LLKDLEEGIQTLMGRLEDGSPRTGQIFKQTYSKFDTN
SHNDDALLKNYGLLYCFRKDMDKVETFLRIVQCRSV
EGSCGF

Figure 1

|   | A | R | N | D | C | Q | E | G | H | I | L | K | M | F | P | S | T | W | Y | V |
|---|---|---|---|---|---|---|---|---|---|---|---|---|---|---|---|---|---|---|---|---|
| A | 2 | -2 | 0 | 0 | -2 | 0 | 0 |  | -1 | -1 | -2 | -1 | -1 | -3 |  |  |  | -6 | -3 | 0 |
| R | -2 | 6 | 0 | -1 | -4 |  | -1 | -3 |  | -2 | -3 |  | 0 | -4 | 0 | 0 | -1 |  | -4 | -2 |
| N | 0 | 0 | 2 |  | -4 |  |  | 0 |  | -2 | -3 |  | -2 | -3 | 0 |  | 0 | -4 | -2 | -2 |
| D | 0 | -1 |  | 4 | -5 |  |  |  |  | -2 | -4 | 0 | -3 | -6 | -1 | 0 | 0 | -7 | -4 | -2 |
| C | -2 | -4 | -4 | -5 | 12 | -5 | -5 | -3 | -3 | -2 | -6 | -5 | -5 | -4 | -3 | 0 | -2 | -8 | 0 | -2 |
| Q | 0 |  |  |  | -5 | 4 |  | -1 |  | -2 | -2 |  | -1 | -5 | 0 | -1 | -1 | -5 | -4 | -2 |
| E | 0 | -1 |  |  | -5 |  | 4 | 0 |  | -2 | -3 | 0 | -2 | -5 | -1 | 0 | 0 | -7 | -4 | -2 |
| G |  | -3 | 0 |  | -3 | -1 | 0 | 5 | -2 | -3 | -4 | -2 | -3 | -5 | 0 |  | 0 | -7 | -5 | -1 |
| H | -1 |  |  |  | -3 |  |  | -2 | 6 | -2 | -2 | 0 | -2 | -2 | 0 | -1 | -1 | -3 | 0 | -2 |
| I | -1 | -2 | -2 | -2 | -2 | -2 | -2 | -3 | -2 | 5 |  | -2 |  |  | -2 | -1 | 0 | -5 | -1 |  |
| L | -2 | -3 | -3 | -4 | -6 | -2 | -3 | -4 | -2 |  | 6 | -3 |  |  | -3 | -3 | -2 | -2 | -1 |  |
| K | -1 |  |  | 0 | -5 |  | 0 | -2 | 0 | -2 | -3 | 5 | 0 | -5 | -1 | 0 | 0 | -3 | -4 | -2 |
| M | -1 | 0 | -2 | -3 | -5 | -1 | -2 | -3 | -2 |  |  | 0 | 6 | 0 | -2 | -2 | -1 | -4 | -2 |  |
| F | -3 | -4 | -3 | -6 | -4 | -5 | -5 | -5 | -2 |  |  | -5 | 0 | 9 | -5 | -3 | -3 | 0 |  | -1 |
| P |  | 0 | 0 | -1 | -3 | 0 | -1 | 0 | 0 | -2 | -3 | -1 | -2 | -5 | 6 |  | 0 | -6 | -5 | -1 |
| S |  | 0 |  | 0 | 0 | -1 | 0 |  | -1 | -1 | -3 | 0 | -2 | -3 |  | 2 |  | -2 | -3 | -1 |
| T |  | -1 | 0 | 0 | -2 | -1 | 0 | 0 | -1 | 0 | -2 | 0 | -1 | -3 | 0 |  | 3 | -5 | -3 | 0 |
| W | -6 |  | -4 | -7 | -8 | -5 | -7 | -7 | -3 | -5 | -2 | -3 | -4 | 0 | -6 | -2 | -5 | 17 | 0 | -6 |
| Y | -3 | -4 | -2 | -4 | 0 | -4 | -4 | -5 | 0 | -1 | -1 | -4 | -2 |  | -5 | -3 | -3 | 0 | 10 | -2 |
| V | 0 | -2 | -2 | -2 | -2 | -2 | -2 | -1 | -2 |  |  | -2 |  | -1 | -1 | -1 | 0 | -6 | -2 | 4 |

Figure 2

MODIFIED GROWTH HORMONE

RELATED APPLICATIONS

This application is a continuation of and claims priority under 35 U.S.C. §120 to copending U.S. application Ser. No. 11/267,871, filed Nov. 3, 2005, to Thierry Guyon, Gilles Borrelly, Lila Drittanti and Manuel Vega, which claims benefit of priority under 35 U.S.C. §119(e) to U.S. Provisional Application Ser. No. 60/625,652, filed Nov. 4, 2004, to Thierry Guyon, Gilles Borrelly, Lila Drittanti and Manuel Vega, entitled "MODIFIED GROWTH HORMONES" and to U.S. Provisional Application Ser. No. 60/706,697, filed Aug. 8, 2005, to Thierry Guyon, Gilles Borrelly, Lila Drittanti and Manuel Vega, entitled "MODIFIED GROWTH HORMONES." The subject matter of each of these applications and provisional applications are herein incorporated by reference in their entirety.

This application is related to International PCT application No. PCT/IB2005/003662, filed Nov. 4, 2005, and published as WO2006048777 on May 11, 2006, entitled "MODIFIED GROWTH HORMONES," to Nautilus Biotech, Thierry Guyon, Gilles Borrelly, Lila Drittanti, and Manuel Vega, which also claims priority to U.S. Provisional Application Ser. No. 60/625,652 and to U.S. Provisional Application Ser. No. 60/706,697.

This application also is related to U.S. application Ser. No. 10/658,834, filed Sep. 8, 2003, and published as Application No. US-2004-0132977-A1; to published International PCT Application WO 2004/022593, entitled, "RATIONAL EVOLUTION OF CYTOKINES FOR HIGHER STABILITY, THE CYTOKINES AND ENCODING NUCLEIC ACID MOLECULES," to Rene Gantier, Thierry Guyon, Manuel Vega and Lila Drittanti; to U.S. application Ser. No. 11/176,830, filed Jul. 6, 2005, and published as Application No. US-2006-0020116, to Rene Gantier, Thierry Guyon, Manuel Vega and Lila Drittanti. This application also is related to U.S. application Ser. No. 10/658,355, filed Sep. 8, 2003, and published as Application No. US-2005-0202438; to International PCT Application WO 2004/022747, entitled "RATIONAL DIRECTED PROTEIN EVOLUTION USING TWO-DIMENSIONAL RATIONAL MUTAGENESIS SCANNING," to Rene Gantier, Thierry Guyon, Cruz Ramos Hugo, Manuel Vega and Lila Drittanti; and to U.S. application Ser. No. 11/196,067, filed Aug. 2, 2005, and published as Application No. US-2006-0020396. The subject matter of each of these related applications is incorporated by reference in its entirety.

INCORPORATION BY REFERENCE OF SEQUENCE LISTING PROVIDED ON COMPACT DISCS

An electronic version on compact disc (CD) ROM of a computer-readable form of the Sequence Listing is filed herewith in duplicate, the contents of which are incorporated by reference in their entirety. The computer-readable file on each of the aforementioned duplicate compact discs created on Jun. 26, 2006, is identical, 679 kilobytes in size, and is entitled 925BSEQ.001.txt.

FIELD OF INVENTION

Modified growth hormone (GH) proteins having properties, including structural and/or physical properties, that differ from unmodified and/or wild type GH proteins are provided. Nucleic acid molecules encoding these proteins are provided as are methods of treatment and diagnosis using the modified growth hormone proteins.

BACKGROUND

The delivery of therapeutic proteins for clinical use is a challenge to pharmaceutical science. Once in the bloodstream, these proteins are continually eliminated from the circulation within a short time by different physiological processes, involving metabolism as well as clearance using normal pathways for protein elimination, such as (glomerular) filtration in the kidneys or proteolysis in blood. The latter is often the limiting process affecting the half-life of proteins used as therapeutic agents in per-oral administration and intravenous or intramuscular injection. The problems associated with these routes of administration of proteins are well known and various strategies have been used in attempts to solve them.

A therapeutic protein family that has been the focus of clinical work and efforts to improve its administration and bio-assimilation is the cytokine family, including, human growth hormone (hGH). A human growth hormone was discovered in 1912 by Harvey Cushing. In 1956, endocrinologist Maurice Raben isolated this hormone from human and monkey tissue and injected a dwarf child in 1958. Since that time, the use of hGH as an approved biopharmaceutical went through two phases. During the first phase from 1958 to 1985, hGH was obtained from extracts of human hypophysis. Because heat destroys GH, these extracts cannot be heated and completely purified from other biological contaminants, such as, potentially, the causative agents of the Creutzfeldt-Jacob disease. In 1985, the FDA prohibited the use of extracted hGH. The second phase in the pharmaceutical use of hGH began with the advent of recombinant DNA technology, concomitant with the arrival of the Orphan Drug Act voted by the American Congress in 1983. Technologies based on recombinant DNA made it possible to produce recombinant hGH in vitro from either mammalian or bacterial cell culture in industrial amounts.

Human GH has been approved for the treatment of a variety of diseases, disorders and conditions, such as child growth hormone deficiency, adult growth hormone deficiency, Turner Syndrome, chronic renal insufficiency, cachexia related to AIDS and short bowel syndrome. Thus, growth hormone, as are other cytokines, are important therapeutic agents. Naturally-occurring variants often have undesirable side effects, as well as the above-noted problems of administration, bioavailability and short half-life. Hence, there is a need to improve properties of GH for its use as a therapeutic. Therefore, among the objects herein, it is an object to provide GH variants that have improved therapeutic properties.

SUMMARY

Provided herein are modified growth hormones (GHs) that exhibit altered activities that result in improved therapeutic properties. Among the activities that are altered is increased protein stability compared to an unmodified growth hormone. The use of growth hormone is well established for humans and other animals. Administration of wildtype GH requires frequent and repeated applications due to its instability in the blood stream and under storage conditions. Modified GHs provided herein are variants of GH that display altered activities, such as improved stability, which results in increased protein half-life, including increased stability in the bloodstream and/or under storage conditions. The improved stability includes stability as assessed by resistance to proteases and/or increased thermal tolerance.

Modified growth hormone polypeptides provided herein exhibit increased protein stability. Among the variants provided are those that are modified at one or more amino acid positions compared to an unmodified GH polypeptide. The modified growth hormone polypeptides provided herein include precursor forms and mature forms, longer forms and shorter forms; modifications are described with reference to the mature form, but also include modified precursor polypeptides. One of skill in the art can readily determine corresponding positions on a particular polypeptide, such as by alignment of unchanged residues.

Provided herein are modified growth hormone polypeptides containing one to five amino acid replacements at positions corresponding to any of amino acid positions 1 to 55, 57, 58, 60 to 63, 67 to 87, 89-91, 93, 95 to 100, 102 to 128, 131 to 132, 135 to 139, 141, 142, 144, 148 to 182, 184, 185 and 187 to 191 of mature human growth hormone compared to unmodified growth hormone, where a mature human growth hormone contains a sequence of amino acid residues set forth in SEQ ID NO:1. It is to be understood that there are allelic variants, species variants and isoforms of the polypeptide whose sequence is set forth in SEQ ID NO:1, such polypeptides also can be modified at loci corresponding the polypeptides exemplified herein. The modified growth hormone exhibits increased protein stability compared to the unmodified growth hormone of SEQ ID NO:1 or 712, which sets forth a precursor form that includes a signal sequence.

Provided herein are modified growth hormone polypeptides containing one or more single amino acid residue replacements, which occur at one or more of any of positions 1 to 12, 14 to 26, 29 to 53, 57, 58, 60 to 63, 67 to 78, 80 to 84, 86, 87, 89, 91, 93, 95 to 100, 102 to 113, 115 to 128, 131, 132, 135 to 139, 141, 142, 144, 148 to 160, 162 to 182, 185 and 187 to 191 relative to mature human growth hormone compared to unmodified growth hormone, where a mature human growth hormone has a sequence of amino acid residues set forth in SEQ ID NO:1, and the modified growth hormone exhibits increased protein stability compared to the unmodified growth hormone, which contains a sequence of amino acids set forth in SEQ ID NO:1 or 712.

Provided herein is a modified growth hormone having one or more single amino acid replacements compared to the unmodified growth hormone, and wherein the replacement positions are not positions that correspond to positions 13, 27, 28, 54-56, 59, 64 to 66, 79, 85, 88, 90, 92, 94, 101, 114, 129, 130, 133, 134, 140, 143, 145 to 147, 161, 183, 184 and 186 of mature human growth hormone set forth as SEQ ID NO:1. In a particular embodiment, the modified growth hormone exhibits increased protein stability compared to the unmodified growth hormone. Increased protein stability can be manifested as increased serum half-life.

Provided herein is a modified growth hormone having one or more single amino acid replacements compared to an unmodified growth hormone in positions corresponding to any of amino acid positions 1 to 55, 57, 58, 60 to 63, 67 to 87, 89-91, 93, 95-100, 102 to 128, 131, 132, 135 to 139, 141, 142, 144, 148 to 182, 184, 185 and 187 to 191 of mature human growth hormone set forth as SEQ ID NO:1, 712 or 713. In a particular embodiment provided herein, the modified growth hormone exhibits increased protein stability compared to the unmodified growth hormone, wherein if position 9 is replaced, the replacing amino acid is not proline, if position 14 is replaced, the replacing amino acid is not serine, if position 13 or 27 is replaced, the replacing amino acid is not valine, if position 28 is replaced, the replacing amino acid is not phenylalanine, if position 54 is replaced, the replacing amino acid is not tyrosine, if position 55, 79, 85 or 184 is replaced, the replacing amino acid is not alanine, if position 90 is replaced, the replacing amino acid is not isoleucine, if position 114 or 161 is replaced, the replacing amino acid is not methionine, and if position 120 or 126 is replaced, the replacing amino acid is not arginine.

The modified growth hormones provided herein include amino acid replacement(s) at one or more of the following positions: 1, 2, 5, 6, 8, 9, 10, 11, 14, 15, 16, 19, 20, 23, 25, 26, 28, 30, 31, 32, 33, 35, 37, 38, 39, 41, 42, 44, 45, 48, 52, 54, 61, 70, 73, 74, 75, 76, 77, 80, 81, 82, 86, 87, 89, 93, 97, 103, 107, 111, 112, 113, 114, 115, 116, 117, 118, 119, 124, 125, 127, 128, 139, 153, 154, 156, 157, 158, 160, 162, 163, 164, 166, 167, 168, 169, 170, 171, 172, 174, 176, 177, 178, and 191 of the mature human growth hormone polypeptide. In one embodiment, the positions include F1, P2, P5, L6, R8, L9, F10, D11, M14, L15, R16, R19, L20, L23, F25, D26, Y28, E30, F31, E32, E33, Y35, P37, K38, E39, K41, Y42, F44, L45, P48, L52, F54, P61, K70, L73, E74, L75, L76, R77, L80, L81, L82, W86, L87, P89, L93, F97, Y103, D107, Y111, D112, L113, L114, K115, D116, L117, E118, E119, L124, M125, R127, L128, F139, D153, D154, L156, L157, K158, Y160, L162, L163, Y164, F166, R167, K168, D169, M170, D171, K172, E174, F176, L177, R178, and F191 of mature human growth hormone. In one embodiment, positions are replaced as follows: replacing R by H or Q, replacing E by H, Q or N, replacing K by Q or N, replacing D by N or Q, replacing M by I or V, replacing P by A or S, replacing Y by I or H, replacing F by I or V, replacing W by H or S and replacing L by I or V. For example, such replacements include F1I (i.e., replacement of F by I at a position corresponding to amino acid position 1 of mature human growth hormone (e.g., SEQ ID NO: 1 or 712)), F1V, P2A, P2S, P5A, P5S, L6I, L6V, R8H, R8Q, L9I, L9V, F10I, F10V, D11N, D11Q, M14I, M14V, L15I, L15V, R16H, R16Q, R19H, R19Q, L20I, L20V, L23I, L23V, F25I, F25V, D26N, D26Q, Y28H, Y28I, E30Q, E30H, E30N, F31I, F31V, E32Q, E32H, E32N, E33Q, E33H, E33N, Y35H, Y35I, P37A, P37S, K38N, K38Q, E39Q, E39H, E39N, K41N, K41Q, Y42H, Y42I, F44I, F44V, L45I, L45V, P48A, P48S, L52I, L52V, F54I, F54V, P61A, P61S, K70N, K70Q, L73I, L73V, E74Q, E74H, E74N, L75I, L75V, L76I, L76V, R77H, R77Q, L80I, L80V, L81I, L81V, L82I, L82V, W86H, W86S, L87I, L87V, P89A, P89S, L93I, L93V, F97I, F97V, Y103H, Y103I, D107N, D107Q, Y111H, Y111I, D112N, D112Q, L113I, L113V, L114I, L114V, K115N, K115Q, D116N, D116Q, L17I, L117V, E118Q, E118H, E118N, E119Q, E119H, E119N, L124I, L124V, M125I, M125V, R127H, R127Q, L128I, L128V, F139I, F139V, D153N, D153Q, D154N, D154Q, L156I, L156V, L157I, L157V, K158N, K158Q, Y160H, Y160I, L162I, L162V, L163I, L163V, Y164H, Y164I, F166I, F166V, R167H, R167Q, K168N, K168Q, D169N, D169Q, M170I, M170V, D171N, D171Q, K172N, K172Q, E174Q, E174H, E174N, F176I, F176V, L177I, L177V, R178H, R178Q, F191I and F191V.

In another embodiment, the modified growth hormones provided herein include amino acid replacement(s) at one or more of the following positions: 1, 2, 5, 9, 11, 14, 16, 23, 26, 38, 41, 42, 73, 74, 81, 87, 111, 112, 116, 119, 124, 125, 153, 156, 157, 158, 162, 166, 167, 168, 169, 171, 172, 174, 177, 178 and 191 of a mature human growth hormone polypeptide containing a sequence of amino acid residues set forth in SEQ ID NO:1. In one embodiment, the positions include F1, P2, P5, L9, D11, M14, R16, L23, D26, K38, K41, Y42, L73, E74, L81, L87, Y111, D112, D116, E119, L124, M125, D153, L156, L157, K158, L162, F166, R167, K168, D169, D171, K172, E174, L177, R178 and F191 a mature human growth hormone polypeptide. For example, such replacements include, but are not limited to, F1I (i.e., replacement of F by I at a position corresponding to amino acid position 1 of mature growth hormone), P2A, P5S, L9V, D11N, M14V, R16H, L23I, L23V, D26N, K38N, K41Q, Y42H, Y42I, L73V, E74N, L81V, L87V, Y111I, D112N, D116Q, E119Q, L124V, M125I, M125V, D153N, L156I, L157I, K158N, L162I, F166I, R167H, R167Q, K168N, K168Q, D169Q, D171N, D171Q, K172Q, E174Q, E174N, E174H, L177V, L177I, R178Q and F191I. In a particular embodiment, if position F1 is replaced by I or V, then position P2 is replaced by A in a mature human growth hormone polypeptide having the sequence of amino acids set forth in SEQ ID NO:1.

In another embodiment, the modified growth hormones provided herein include amino acid replacement(s) at one or more of the following positions: 6, 9, 13, 15, 17, 20, 23, 24, 105, 110, 113, 114, 117, 121, 124 and 128 of a mature human growth hormone containing a sequence of amino acid residues set forth in SEQ ID NO:1. In one embodiment, the positions include L6, L9, A13, L15, A17, L20, L23, A24, A105, V110, L113, L114, L117, I121, L124 and L128 of a mature human growth hormone. In one embodiment, positions are replaced with E, D, K, R, N, Q, S and/or T. For example, such replacements include L6E (i.e., replacement of L by E at a position corresponding to amino acid position 6 of mature growth hormone), L6D, L6K, L6R, L6N, L6Q, L6S, L6T, L9E, L9D, L9K, L9R, L9N, L9Q, L9S, L9T, A13E, A13D, A13K, A13R, A13N, A13Q, A13S, A13T, L15E, L15D, L15K, L15R, L15N, L15Q, L15S, L15T, A17E, A17D, A17K, A17R, A17N, A17Q, A17S, A17T, L20E, L20D, L20K, L20R, L20N, L20Q, L20S, L20T, L23E, L23D, L23K, L23R, L23N, L23Q, L23S, L23T, A24E, A24D, A24K, A24R, A24N, A24Q, A24S, A24T, A105E, A105D, A105K, A105R, A105N, A105Q, A105S, A105T, V110E, V110D, V110K, V110R, V110N, V110Q, V110S, V110T, L113E, L113D, L113K, L113R, L113N, L113Q, L113S, L113T, L114E, L114D, L114K, L114R, L114N, L114Q, L114S, L114T, L117E, L117D, L117K, L117R, L117N, L117Q, L117S, L117T, I121E, I121D, I121K, I121R, I121N, I121Q, I121S, I121T, L124E, L124D, L124K, L124R, L124N, L124Q, L124S, L124T, L128E, L128D, L128K, L128R, L128Q, L128N, L128S and L128T.

Provided herein are any modified growth hormones as described above, further having one or more single amino acid replacements at positions 6, 9, 13, 15, 17, 20, 23, 24, 105, 110, 113, 114, 117, 121, 124 and/or 128 of a mature human growth hormone containing a sequence of amino acid residues s set forth in SEQ ID NO:1, where if position 13 is replaced, the replacing amino acid is not valine, and if position 114 is replaced, the replacing amino acid is not methionine. In one embodiment, the positions include L6, L9, A13, L15, A17, L20, L23, A24, A105, V110, L113, L114, L117, L121, L124 and L128. In one embodiment, positions are replaced with E, D, K, R, N, Q, S and/or T. For example, such replacements include L6E, L6D, L6K, L6R, L6N, L6Q, L6S, L6T, L9E, L9D, L9K, L9R, L9N, L9Q, L9S, L9T, A13E, A13D, A13K, A13R, A13N, A13Q, A13S, A13T, L15E, L15D, L15K, L15R, L15Q, L15N, L15S, L15T, A17E, A17D, A17K, A17R, A17N, A17Q, A17S, A17T, L20E, L20D, L20K, L20R, L20N, L20Q, L20S, L20T, L23E, L23D, L23K, L23R, L23N, L23Q, L23S, L23T, A24E, A24D, A24K, A24R, A24N, A24Q, A24S, A24T, A105E, A105D, A105K, A105R, A105N, A105Q, A105S, A105T, V110E, V110D, V110K, V110R, V110N, V110Q, V110S, V110T, L113E, L113D, L113K, L113R, L113N, L113Q, L113S, L113T, L114E, L114D, L114K, L114R, L114N, L114Q, L114S, L114T, L117E, L117D, L117K, L117R, L117N, L117Q, L117S, L117T, I121E, I121D, I121K, I121R, I121N, I121Q, I121S, I121T, L124E, L124D, L124K, L124R, L124N, L124Q, L124S, L124T, L128E, L128D, L128K, L128R, L128Q, L128N, L128S and L128T.

Provided herein are any of the modified growth hormones described above wherein the number of positions replaced is 2, 3, 4, 5, 6, 7, 8, 9, 10, 11, 12, 13, 14, 15, 16, 17, 18, 19, or 20 compared to unmodified growth hormone. In one embodiment, the modified growth hormones provided herein include amino acid replacement(s) at one or more of the following positions: 56, 59, 64, 65, 66, 88, 92, 94, 101, 129, 130, 133, 134, 140, 143, 145, 146, 147, 183, and 186 of a mature human growth hormone containing a sequence of amino acids set forth in SEQ ID NO:1. In one embodiment, the positions include E56, P59, R64, E65, E66, E88, F92, R94, L101, E129, D130, P133, R134, K140, Y143, K145, F146, D147, R183 and E186. In one embodiment, positions are replaced as follows: replacing E with any of Q, N and H, replacing P with S or A, replacing R with H or Q, replacing L or F with I or V, replacing K or D with Q or N, and replacing Y with H or I. For example, such replacements include E56Q, E56N, E56H, P59S, P59A, R64H, R64Q, E65Q, E65N, E65H, E66Q, E66N, E66H, E88Q, E88N, E88H, F92I, F92V, R94H, R94Q, L101V, L101I, E129Q, E129N, E129H, D130Q, D130N, P133S, P133A, R134H, R134Q, K140Q, K140N, Y143H, Y143I, K145Q, K145N, F146I, F146V, D147Q, D147N, R183H, R183Q, E186Q, E186N and E186H.

In one embodiment, the modified growth hormones described above are human growth hormones (hGH). In a particular embodiment, amino acid replacements are made in a human pituitary growth hormone or human placental growth hormone. Alternatively, the modified growth hormones described above are non-human growth hormones.

Provided herein are modified growth hormones having lengths of 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221 or 222 amino acids. In another embodiment, provided herein are modified growth hormones having lengths of 180, 181, 182, 183, 184, 185, 186, 187, 188, 189 or 190 amino acids.

In one embodiment, amino acid replacements are made in the growth hormone sequence set forth in SEQ ID NO:1. In another embodiment, amino acid replacements are made in the precursor growth hormone sequence set forth in SEQ ID NO: 712. Provided herein are modified growth hormones where the one or more amino acid replacements are natural amino acids, non-natural amino acids or a combination of natural and non-natural amino acids.

Provided herein are modified mature human growth hormone polypeptides and modified precursor human growth hormone polypeptides.

In certain embodiments, the modified growth hormone is a naked polypeptide chain. In other embodiments, the polypeptides contain post-translational modifications, such as glycosylated residues. The polypeptides can include other modifications known to those of skill in the art. Hence, provided herein are modified growth hormones where the growth hormone is pegylated, albuminated, glycosylated, or other modifications.

Provided herein are modified growth hormones further having one or more pseudo-wild type mutations. In a particular embodiment, the pseudo-wild-type mutations can be an insertion, a deletion, a replacement or a combination thereof of the amino acid residue(s) of an unmodified growth hormone.

In one aspect, the modified growth hormones exhibit increased stability that is manifested as an increased resistance to proteolysis. In certain embodiments, increased resistance to proteolysis occurs in serum, blood, saliva, digestive fluids or in vitro when exposed to proteases. In one embodiment, increased resistance to proteolysis is exhibited by the modified growth hormone when it is administered orally or is present in the digestive tract. Proteases can be, for example, one or more of gelatinase A, gelatinase B, trypsin, trypsin (Arg blocked), trypsin (Lys blocked), clostripain, endoproteinase Asp-N, chymotrypsin, cyanogen bromide, iodozobenzoate, Myxobacter P., *Armillaria*, luminal pepsin, microvillar endopeptidase, dipeptidyl peptidase, enteropeptidase and hydrolase. In one embodiment, the modified polypeptide is at least 5%, 10%, 15%, 20%, 25%, 30%, 35%, 40%, 45%, 50%, 55%, 60%, 65%, 70%, 75%, 80%, 85%, 90%, 95%, 96%, 97%, 98%, 99%, or 100% more resistant to proteolysis.

In one embodiment where the protease is gelatinase B, the modified polypeptide is resistant to cleave at the sequence of amino acids Met-Ser-Tyr-Asn. In one aspect, the modified polypeptide can be cleaved after the sequence of amino acids Met-Ser-Tyr-Asn. In another aspect, the polypeptide can be modified at each of residues Met, Ser, Tyr, Asn, or a combination thereof, thereby rendering the modified peptide more resistant to proteolysis by gelatinase B. In one embodiment, the modified polypeptide is at least 5%, 10%, 15%, 20%, 25%, 30%, 35%, 40%, 45%, 50%, 55%, 60%, 65%, 70%, 75%, 80%, 85%, 90%, 95%, 96%, 97%, 98%, 99%, or 100% more resistant to proteolysis by gelatinase B at each of residues Met, Ser, Tyr, Asn, or a combination thereof. In one embodiment, resistance to protease can be empirically tested by any of the assays described herein.

In one aspect, the modified growth hormones exhibit increased stability that is manifested as increased thermal tolerance. In one embodiment, the modified growth hormone has increased thermal tolerance at a temperature from about 20° C. to about 45° C. In a one embodiment, the modified growth hormone has increased thermal tolerance at a body temperature of a subject. In a particular embodiment, the modified growth hormone has increased thermal tolerance at a temperature of about 37° C.

In one aspect, the modified growth hormones exhibit increased stability that is manifested as an increased half-life in vivo or in vitro. In one embodiment, increased stability is manifested as an increased half-life when administered to a subject. Half-life (serum stability) of the modified growth hormone can be increased by an amount such as 10%, at least 20%, at least 30%, at least 40%, at least 50%, at least 60%, at least 70%, at least 80%, at least 90%, at least 100%, at least 150%, at least 200%, at least 250%, at least 300%, at least 350%, at least 400%, at least 450%, and at least 500% or more compared to the half-life of unmodified growth hormone. In another embodiment, half-life (serum stability) of the modified growth hormone can be increased by an amount such as at least 6 times, 7 times, 8 times, 9 times, 10 times, 20 times, 30 times, 40 times, 50 times, 60 times, 70 times, 80 times, 90 times, 100 times, 200 times, 300 times, 400 times, 500 times, 600 times, 700 times, 800 times, 900 times, and 1000 times or more times when compared to the half-life of unmodified growth hormone.

Modified growth hormones provided herein exhibit altered activity, typically increased or improved activity, compared to the unmodified growth hormone. In another aspect, the modified growth hormones exhibit a decrease in an activity compared to the unmodified growth hormone. Activity can be assessed using assays known to those of skill in the art. An exemplary activity can be assessed by measuring cell proliferation in vitro. The modified growth hormone also can be assessed, for example, for altered binding to a growth hormone receptor. Other assays correlated with or that directly assess growth hormone activities are known.

Provided herein are modified growth hormones that exhibit increased resistance to proteolysis and exhibits decreased thermal tolerance compared to the unmodified growth hormone.

Provided herein are modified growth hormones that exhibit increased thermal tolerance and exhibits decreased resistance to proteolysis compared to the unmodified growth hormone.

Provided herein are libraries having two, three, four, five, six, ten, fifty, one hundred, two hundred or more of any of the modified growth hormones provided herein.

Provided herein are nucleic acid molecules containing a sequence of nucleotides encoding a modified growth hormone as described herein. Provided herein are libraries of nucleic acid molecules containing a plurality of the molecules described herein.

Provided herein are vectors containing nucleic acid molecule as described herein. Provided herein are cells carrying the nucleic acid molecules or vectors as described herein. In one embodiment, the cell is a eukaryotic cell, a prokaryotic cell, an insect cell, a mammalian cell, etc. Also provided herein are libraries having a plurality of the vectors.

Provided herein is a method for expressing a modified growth hormone having steps including: i) introducing a nucleic acid or a vector into a cell, and ii) culturing the cell under conditions in which the encoded modified growth hormone is expressed. In one embodiment, the vectors are in a eukaryotic cell, a prokaryotic cell, an insect cell, a mammalian cell, a plant cell, etc. In one embodiment, the modified growth hormone is glycosylated. In one embodiment, the cell is a eukaryotic cell.

Provided herein are methods for producing a modified target protein, having an evolved predetermined property or activity, the method including the steps of: a) selecting, on a target protein, one or more is-HIT target amino acids amenable to providing the evolved predetermined property or activity upon amino acid replacement; wherein the is-HIT target amino acids are determined by identifying structurally homologous loci between the evolving target protein and a modified growth hormone described herein possessing the predetermined property or activity; b) replacing each target amino acid with a replacement amino acid amenable to providing the evolved predetermined property or activity to form a candidate lead protein, wherein only one amino acid replacement occurs on each target protein; c) expressing from a nucleic acid molecule each candidate lead protein in a cell contained in an addressable array; and d) assaying each candidate LEAD protein to identify one or more proteins that have the predetermined property or activity that differs from an unmodified protein, thereby identifying evolved target proteins that are LEADs. In one embodiment, the method further includes the steps of: e) comparing the 3-dimensional structures of the evolving protein and the modified growth hormone to identify regions of high coincidence between their backbones, the regions designated as structurally homologous regions; and f) identifying is-HIT structurally homologous loci on the evolving protein that correspond to structurally related is-HIT amino acid positions within a structurally homologous region of the modified growth hormone. In one embodiment, the predetermined property or activity is protein stability, protein half life in vivo, thermal tolerance or resistance to proteolysis. Provided herein is a modified cytokine produced by the above method.

Provided herein are modified growth hormone polypeptides produced by any of the methods described herein.

Provided herein are modified growth hormones having any of the sequences of amino acid residues as set forth in SEQ ID NOS: 2-69, 75, 76, 85-107, 111, 112, 115, 116, 119, 120, 123-154, 164, 165, 176-216,222-351 or an active portion thereof.

Provided herein are pharmaceutical compositions including any of the modified growth hormone polypeptides described herein. Pharmaceutical compositions can further include a pharmaceutically acceptable excipient, such as a binding agent, a filler, a lubricant, a disintegrant and a wetting agent.

The pharmaceutical compositions can be formulated for oral, nasal or pulmonary administration. In a particular embodiment, the pharmaceutical compositions are formulated for oral administration. The modified growth hormone in the pharmaceutical composition in the pharmaceutical formulation exhibits increased half-life under conditions selected from exposure to saliva, exposure to proteases in the gastrointestinal tract and exposure to low pH conditions compared to wild-type cytokine.

Provided in the pharmaceutical compositions herein are modified growth hormone polypeptides, where the modification includes removal of proteolytic digestion sites or increasing the stability of the protein structure. The modified growth hormone in the pharmaceutical composition exhibits increased protein half-life or bioavailability in the gastrointestinal tract. Protein half-life (serum stability) can be increased in an amount of at least 10%, at least 20%, at least 30%, at least 40%, at least 50%, at least 50%, at least 60%, at least 70%, at least 80%, at least 90%, at least 100%, at least 150%, at least 200%, at least 250%, at least 300%, at least 350%, at least 400%, at least 450% or at least 500% or more compared to the half-life of wild-type protein. Alternatively, protein half-life can increased in an amount of at least 6 times, at least 7 times, at least 8 times, at least 9 times, at least 10 times, at least 20 times, at least 30 times, at least 40 times, at least 50 times, at least 60 times, at least 70 times, at least 80 times, at least 90 times, at least 100 times, at least 200 times, at least 300 times, at least 400 times, at least 500 times, at least 600 times, at least 700 times, at least 800 times, at least 900 times or at least 1000 times or more compared to wild-type protein.

Provided herein, protein half-life (serum stability) is increased in the presence of one or more proteases. In one embodiment, an activity of the modified growth hormone is increased compared to the wild-type growth hormone.

Protein half-life can be increased after exposure to one or more conditions including, but not limited to, exposure to saliva, exposure to proteases in the gastrointestinal tract and exposure to low pH conditions (e.g., the stomach).

Provided herein are pharmaceutical compositions prepared without the use of protease inhibitors, such as a Bowman-Birk inhibitor, a conjugated Bowman-Birk inhibitor, aprotinin and camostat.

Provided herein are pharmaceutical compositions formulated for oral administration in a form such as a liquid, a pill, a tablet or a capsule. In one embodiment, the pill or tablet is chewable. In one embodiment, the pill or tablet dissolves when exposed to saliva on the tongue or in the mouth. In one embodiment, the pharmaceutical composition in the capsule is in liquid form. In an embodiment wherein the pharmaceutical composition is a liquid, the liquid is can be, for example, a solution, a syrup or a suspension.

Provided herein are pharmaceutical compositions formulated for controlled release of the modified growth hormone polypeptide. In one such example, the pharmaceutical composition is in the form of a tablet or a lozenge. Lozenges deliver the modified growth hormone to the mucosa of the mouth, the mucosa of the throat or the gastrointestinal tract. Additionally, the lozenge can be formulated with an excipient, such as among anhydrous crystalline maltose and magnesium stearate.

Provided herein are pharmaceutical compositions formulated without protective compounds. In one such embodiment, the modified growth hormone exhibits resistance to intestinal proteases.

Pharmaceutical compositions can be further formulated with one or more pharmaceutically-acceptable additives, such as a suspending agent, an emulsifying agent, a non-aqueous vehicle, and/or a preservative.

Provided herein are pharmaceutical compositions of nucleic acid molecules encoding any of the modified growth hormone polypeptides described herein or a vector having a nucleic acid molecule encoding any of the modified growth hormone polypeptides described herein and a pharmaceutically acceptable excipient.

Provided herein are methods of treating a subject having a growth hormone-mediated disease or condition by administering any of the pharmaceutical compositions described herein.

Provided herein are methods of treating a subject having a growth hormone-mediated disease or condition by administering a pharmaceutical composition as described herein. In one embodiment, the growth hormone-mediated disease or condition includes, but is not limited to a growth deficiency disorder, AIDS wasting, aging, impaired immune function of HIV-infected subjects, a catabolic illness, surgical recovery, a congestive cardiomyopathy, liver transplantation, liver regeneration after hepatectomy, chronic renal failure, renal osteodystrophy, osteoporosis, achondroplasia/hypochondroplasia, skeletal dysplasia, a chronic inflammatory or nutritional disorder such as Crohn's disease, short bowel syndrome, juvenile chronic arthritis, cystic fibrosis, male infertility, X-linked hypophosphatemic rickets, Down's syndrome, Spina bifida, Noonan Syndrome, obesity, impaired muscle strength and fibromyalgia. In a particular embodiment, the growth deficiency disorder can be selected from among Turner's syndrome, intrauterine growth retardation, idiopathic short stature, Prader Willi syndrome, and thalassaemia. In one embodiment, the symptoms of the subject are ameliorated or eliminated.

Provided herein are articles of manufacture including, but not limited to, packaging material and a pharmaceutical composition of a modified growth hormone polypeptide described herein contained within the packaging material. In a particular embodiment, the pharmaceutical composition packaged within the article of manufacture is effective for treatment of a growth hormone-mediated disease or disorder, and the packaging material includes a label that indicates that the modified growth hormone is used for treatment of an growth hormone-mediated disease or disorder.

Provided herein are kits including a pharmaceutical composition of a modified growth hormone polypeptide as described herein, a device for administration of the modified growth hormone polypeptide and optionally instructions for administration.

Provided herein is the use of any of the modified growth hormone polypeptides provided herein for the formulation of a medicament for treatment of a subject having a disease or condition that is treated by the administration of growth hormone. Provided herein is the use of a pharmaceutical composition provided herein for treatment of a subject having a disease or condition that is treated by the administration of growth hormone. In one embodiment, the disease or condition is any of a growth deficiency disorder, AIDS wasting, aging, impaired immune function of HIV-infected subjects, a catabolic illness, surgical recovery, a congestive cardiomyopathy, liver transplantation, liver regeneration after hepatectomy, chronic renal failure, renal osteodystrophy, osteoporosis, achondroplasia/hypochondroplasia, skeletal dysplasia, a chronic inflammatory or nutritional disorder such as Crohn's disease, short bowel syndrome, juvenile chronic arthritis, cystic fibrosis, male infertility, X-linked hypophosphatemic rickets, Down's syndrome, Spina bifida, Noonan Syndrome, obesity, impaired muscle strength and fibromyalgia. In one aspect, the growth deficiency disorder is any of Turner's syndrome, intrauterine growth retardation, idiopathic short stature, Prader Willi syndrome and thalassaemia.

BRIEF DESCRIPTION OF THE FIGURES

FIG. 1 displays the sequence of mature wild type human growth hormone with amino acids sensitive to proteolysis indicated in bold.

FIG. 2 depicts the "Point Accepted Mutation" (PAM250) matrix used to identify candidate replacing amino acids for the is-HITs. Original amino acids are shown on the horizontal axis and replacement amino acids on the vertical axis. Values given to identical residues are shown in the gray squares. Highest values in the matrix are shown in black squares and correspond to the highest occurrence of substitution between two residues.

DETAILED DESCRIPTION

Figure 3:
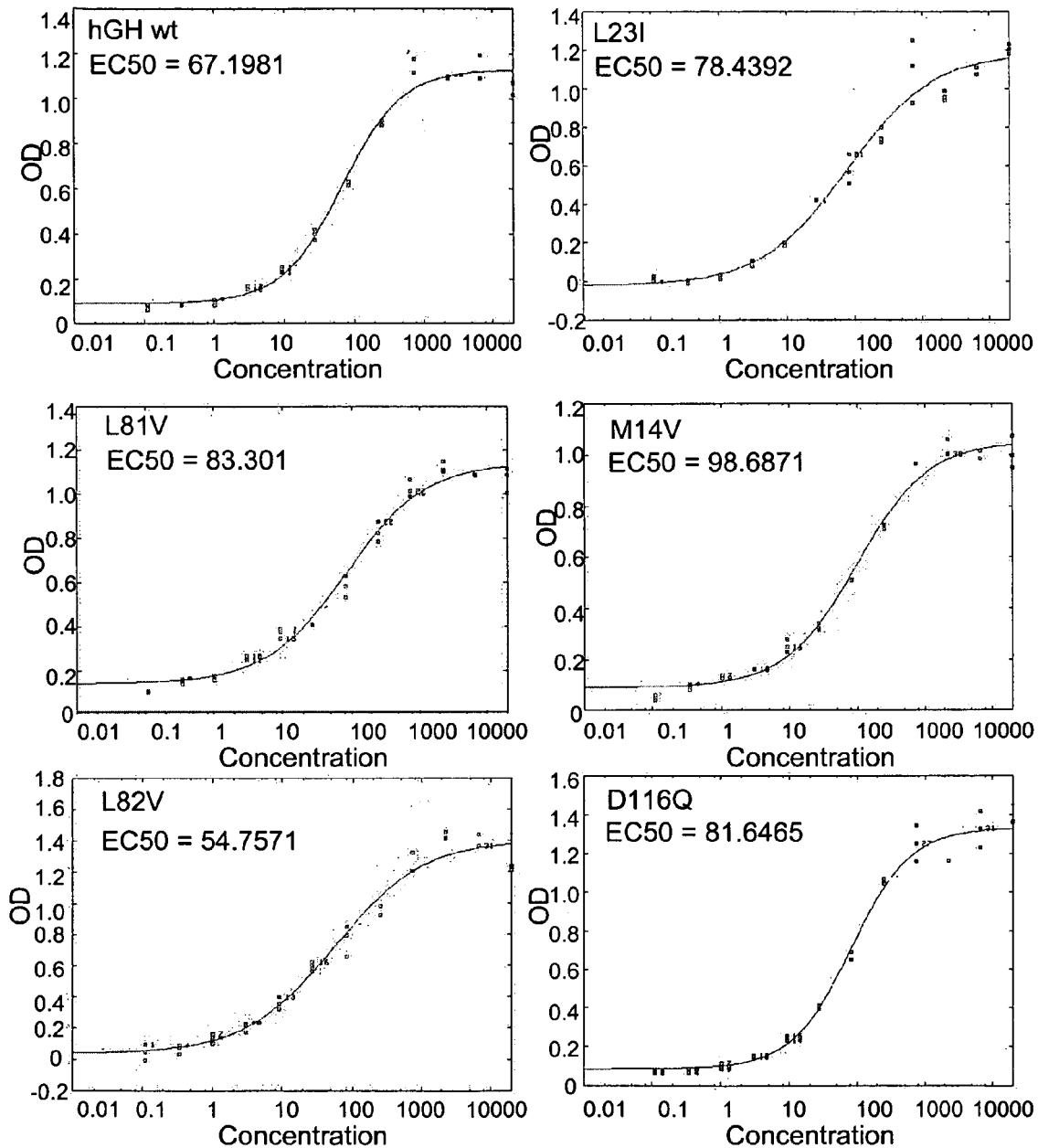
FIG. 3 depicts activity curves of exemplary modified growth hormone variants.

| Outline |
|---|
| A. Definitions |
| B. Growth hormone |
|     1. Growth hormone structure |
|     2. Interaction with growth hormone receptor |
|     3. Growth hormone as a biopharmaceutical |
| C. Exemplary methods for modifying growth hormone |
|     1. 1D Scanning ("Rational Mutagenesis") |
|     2. 3D Scanning |
|     3. 2D-scanning (restricted rational mutagenesis) |
|         a. Identifying in-silico HITs |
|         b. Identifying replacing amino acids |
|         c. Construction of modified polypeptides and biological assays |
| D. Modified growth hormone polypeptides |
|     1. Increased resistance to proteolysis by removal of proteolytic sites |
|         a. Properties of growth hormone polypeptides modified by removal of proteolytic sites |
|         b. Generation of growth hormone polypeptides modified by removal of proteolytic sites |
|         c. Additional modified growth hormone polypeptides |
|         d. Assessment of growth hormone variants with increased resistance to proteolysis |
|     2. Increased thermal tolerance |
|         a. Properties of thermal tolerant modified growth hormone polypeptides |
|             i. Creation of intra-molecular bonds |
|             ii. Increasing polar interactions between helices |
|         b. Assessment of thermal tolerant modified growth hormone polypeptides |

| -continued |
|---|
| Outline |
|     3. Super-LEADs and additional growth hormone modifications |
| E. Production of modified growth hormone polypeptides |
|     1. Expression systems |
|         a. Prokaryotic expression |
|         b. Yeast |
|         c. Insects and insect cells |
|         d. Mammalian cells |
|         e. Plants |
|     2. Purification |
|     3. Fusion proteins |
|     4. Polypeptide modification |
|     5. Nucleotide sequences |
| F. Assessing modified growth hormone activity(ies) |
|     1. In vitro assays |
|     2. Non-human animal models |
|     3. Clinical assays |
| G. Formulation/Administration |
| H. Therapeutic uses |
|     1. Growth deficiencies |
|     2. Cachexia |
|     3. Anti-aging |
|     4. Renal osteodystrophy |
|     5. Cystic fibrosis |
|     6. Other conditions |
| I. Articles of manufacture and kits |
| J. EXAMPLES |

A. Definitions

Unless defined otherwise, all technical and scientific terms used herein have the same meaning as is commonly understood by one of skill in the art to which the invention(s) belong. All patents, patent applications, published applications and publications, GenBank sequences, websites and other published materials referred to throughout the entire disclosure herein, unless noted otherwise, are incorporated by reference in their entirety. In the event that there is a plurality of definitions for terms herein, those in this section prevail. Where reference is made to a URL or other such identifier or address, it understood that such identifiers can change and particular information on the internet can come and go, but equivalent information can be found by searching the internet. Reference thereto evidences the availability and public dissemination of such information.

As used herein, a "growth hormone" polypeptide (also referred to herein as GH) refers to any GH polypeptide (protein) including, but not limited to, recombinantly-produced polypeptide, synthetically-produced polypeptide and GH extracted from cells in tissues including, but not limited to, pituitary and placental tissues. GH polypeptides include precursor growth hormone polypeptides having signal sequences and mature growth hormone polypeptides. GH polypeptides include related polypeptides from different species including, but not limited to animals of human and non-human origin. GH polypeptide amino acid sequences can contain varying number of amino acid residues. For example, GH polypeptides can have 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221 and 222 or more amino acids. GH polypeptides also can be shorter than 191 amino acids, such as 180, 181, 182, 183, 184, 185, 186, 187, 188, 189, or 190 amino acids, wherein the polypeptide retains an activity of the mature GH polypeptide. Human GH (hGH) includes GH, allelic variant isoforms amongst individuals or amongst species, synthetic molecules from nucleic acids, protein isolated from human tissue and cells, protein isolated from non-human tissue and cells, and modified forms thereof. The sequences of exemplary hGH polypeptides are set forth in SEQ ID NOS: 1, 712 and 713. The amino acid sequence of an exemplary mature hGH polypeptide is set forth in SEQ ID NO: 1. The amino acid sequences of exemplary precursor growth hormone polypeptides are set forth in SEQ ID NOS: 712 and 713. The signal peptide for such precursor polypeptides is 26 amino acids in length.

GH polypeptides exhibit allelic variation and species variation. In addition to allelic variations among individuals and species, there are isoforms that occur in the placenta (see, e.g., SEQ ID NO: 712) and isoforms that occur in the pituitary gland (see, e.g., SEQ ID NO: 713). Optionally, hGH does not have the following mutations: P6S, H22D, G34N, or A127V as compared to the amino acid sequences set forth in SEQ ID NOS: 1, 712 and 713. Human GH also includes fragments of GH that are of sufficient length to be functionally active; such fragments are known and/or can be identified by routine assays. For example, cytokine assays to determine functionality and activity of a modified form of GH are known to those of skill in the art.

GH polypeptides have been isolated from a variety of species. Exemplary GH polypeptides of non-human origin include, but are not limited to, bovine, ovine, porcine, rat, rabbit, horse, primate and avian GH polypeptides. The amino acid sequences of exemplary non-human growth hormone polypeptides are set forth in SEQ ID NOS: 714 and 715. GH, including non-human GH polypeptides, include, but are not limited to GH, allelic variant isoforms, synthetic molecules produced from encoding nucleic acid molecules, protein isolated from non-human tissue and cells, and modified forms thereof. Non-human GH also includes fragments of GH that are of sufficient length to be functionally active.

As used herein, an "activity" or "property" of a GH polypeptide (protein) refers to any activity or property exhibited by a GH protein that can be assessed. Such activities include those observed or exhibited in vitro or in vivo (typically referred to as a biological activity). These activities include, but are not limited to, resistance to proteolysis, thermal tolerance, increased half-life and cell proliferation activity.

As used herein, "resistance to proteolysis" refers to any amount of decreased cleavage of a target amino acid residues of a modified polypeptide by a protease compared to cleavage of an unmodified polypeptide by the same protease under the same conditions. A modified polypeptide that exhibits increased resistance to proteolysis exhibits, for example, 1%, 2%, 3%, 4%, 5%, 6%, 7%, 8%, 9%, 10%, ... 20%, ... 30%, ... 40%, ... 50%, ... 60%, ..., 70%, ... 80%, ... 90%, 91%, 92%, 93%, 94%, 95%, 96%, 97%, 98%, 99%, or 100% more resistance to proteolysis than an unmodified polypeptide.

As used herein, "proteases," "proteinases" or "peptidases" are interchangeably used to refer to enzymes that catalyze the hydrolysis of covalent peptidic bonds. For "serine proteases," the mechanism is based on nucleophilic attack of the targeted peptidic bond by a serine. Cysteine, threonine or water molecules associated with aspartate or metals also can play this role. Aligned side chains of serine, histidine and aspartate build the catalytic triad common to most serine proteases. Serine protease or serine endopeptidases constitute a class of peptidases, which are characterized by the presence of a serine residue in the active center of the enzyme. Serine proteases participate in a wide range of functions in the body, including blood clotting, inflammation as well as digestive enzymes in both prokaryotes and eukaryotes. The active site of serine proteases is shaped as a cleft where the polypeptide substrate binds. Amino acid residues are labeled from N to C term of the polypeptide substrate (Pi, ..., P3, P2, P1, P1', P2', P3', ..., Pj) and their respective binding sub-sites (Si, ..., S3, S2, S1, S1', S2', S3', ..., Sj). The cleavage is catalyzed between P1 and P1'.

As used herein, a "portion of a GH polypeptide" refers to any portion that exhibits one or more biological activities of the full-length polypeptide.

As used herein, "native growth hormone" refers to a growth hormone produced by an organism in nature. For example, humans produce pituitary growth hormone and placental growth hormone. Exemplary native human pituitary growth hormone and placental growth hormone are set forth in SEQ ID NOS: 1, 712 and 713. Other animals, such as mammals, produce native growth hormone, for example, bovine native growth hormone, e.g., SEQ ID NO:714, and Rhesus monkey native growth hormone, e.g., SEQ ID NO: 715.

As used herein, "growth hormone-mediated disease, disorder or condition" refers to any disease or disorder in which treatment with growth hormone ameliorates any symptom or manifestation of the disease or disorder. Exemplary growth hormone-mediated diseases and disorders include, but are not limited to, growth deficiency disorders (such as Turner's syndrome, intrauterine growth retardation, idiopathic short stature, Prader Willi syndrome, or thalassaemia), AIDS wasting, aging, impaired immune function of HIV-infected subjects, catabolic illnesses, recovery from surgery, congestive cardiomyopathy, liver transplantation, liver regeneration after hepatectomy, chronic renal failure, renal osteodystrophy, osteoporosis, achondroplasia/hypochondroplasia, skeletal dysplasia, chronic inflammatory or nutritional disorders (such as Crohn's disease), short bowel syndrome, juvenile chronic arthritis, cystic fibrosis, male infertility, X-linked hypophosphatemic rickets, Down's syndrome, Spina bifida, Noonan Syndrome, obesity, impaired muscle strength and fibromyalgia.

As used herein, a "growth hormone deficiency" is any disease, disorder or condition where a subject produces native growth hormone in lower or inadequate amounts than is needed for normal growth, development and/or metabolism. Growth hormone deficiency can result from disruption of the GH axis in the higher brain, hypothalamus, or pituitary. This dysfunction can be congenital or acquired. Congenital growth hormone deficiency can be associated with an abnormal pituitary gland (seen on MRI) or can be part of a syndrome, such as septooptic dysplasia (de Morsier syndrome), which can include other pituitary deficiencies, optic nerve hypoplasia, and absence of the septum pellucidum. Acquired growth hormone deficiency, on the other hand, can result from trauma, infection (e.g., encephalitis, meningitis), cranial irradiation (somatotrophs appear to be the most radiation-sensitive cells in the pituitary), and/or other systemic diseases (e.g., histiocytosis).

As used herein, "treatment" means any manner in which the symptoms of a condition, disorder or disease are ameliorated or otherwise beneficially altered. Treatment also encompasses any pharmaceutical use of the modified growth hormones and compositions provided herein.

By "treating" a subject having a disease or condition, it is meant that the patient's symptoms are partially or totally alleviated, or remain static following treatment. A subject who has been treated will exhibit a partial or total alleviation of symptoms. Hence treatment encompasses prophylaxis, therapy and/or cure. Treatment also encompasses any pharmaceutical use of a modified growth hormone and compositions provided herein.

The phrase "therapeutically effective amount" or "therapeutically effective dose" as used herein means that amount of an agent, compound, material, or composition of a compound is an amount effective for producing a desired therapeutic effect (e.g., amelioration of disease symptoms).

A "patient" or "subject" to be treated generally refers to mammals, (i.e., a human or non-human animal). Mammals include primates, such as, a human, a chimpanzee, a gorilla and a monkey, a domesticated animal, such as a dog, a horse, a cat, a pig, a cow), a farm animal, such as a cow, pig or other such animal, and a rodent, such as a mouse or a rat.

As used herein, "a directed evolution method" refers to methods that "adapt" proteins, including natural proteins, synthetic proteins or protein domains to have changed proportions, such as the ability to act in different or existing natural or artificial chemical or biological environments and/or to elicit new functions and/or to increase or decrease a given activity, and/or to modulate a given feature. Exemplary directed evolution methods include, among others, rational directed evolution methods described in U.S. application Ser. No. 10/022,249; and U.S. Published Application No. US-2004-0132977-A1.

As used herein, "two dimensional rational mutagenesis scanning (2D scanning)" refers to the processes provided herein in which two dimensions of a particular protein sequence are scanned: (1) one dimension is to identify specific amino acid residues along the protein sequence to replace with different amino acids, referred to as is-HIT target positions, and (2) the second dimension is the amino acid type selected for replacing the particular is-HIT target, referred to as the replacing amino acid.

As used herein, "in silico" refers to research and experiments performed using a computer. In silico methods include, but are not limited to, molecular modeling studies and biomolecular docking experiments.

As used herein, "is-HIT" refers to an in silico identified amino acid position along with a target protein sequence that has been identified based on i) the particular protein properties to be evolved, ii) the protein's sequence of amino acids, and/or iii) the known properties of the individual amino acids. These is-HIT loci on the protein sequence are identified without use of experimental biological methods. For example, once the protein feature(s) to be optimized is (are) selected, diverse sources of information or previous knowledge (e.g., protein primary, secondary or tertiary structures, literature, patents) are exploited to determine those amino acid positions that are amenable to improved protein fitness by replacement with a different amino acid. This step utilizes protein analysis "in silico." All possible candidate amino acid positions along a target protein's primary sequence that might be involved in the feature being evolved are referred to herein as "in silico HITs" ("is-HITs"). The library (collection), of all is-HITs identified during this step represents the first dimension (target residue position) of the two-dimensional scanning methods provided herein.

As used herein, "amenable to providing the evolved predetermined property or activity," in the context of identifying is-HITs, refers to an amino acid position on a protein that is contemplated, based on in silico analysis, to possess properties or features that when replaced would result in the desired activity being evolved. The phrase "amenable to providing the evolved predetermined property or activity," in the context of identifying replacement amino acids, refers to a particular amino acid type that is contemplated, based on in silico analysis, to possess properties or features that, when used to replace the original amino acid in the unmodified starting protein, would result in the desired activity being evolved.

As used herein, "high-throughput screening (HTS)" refers to a process that tests a large number of samples, such as samples of test proteins or cells containing nucleic acids encoding the proteins of interest, to identify structures of interest or to identify test compounds that interact with the variant proteins or cells containing them. HTS operations are amenable to automation and are typically computerized to handle sample preparation, assay procedures and the subsequent processing of large volumes of data.

As used herein, the term "restricted," when used in the context of the identification of is-HIT amino acid positions along the protein sequence selected for amino acid replacement and/or the identification of replacing amino acids, means that fewer than all amino acids on the protein-backbone are selected for amino acid replacement; and/or fewer than all of the remaining 19 amino acids available to replace the original amino acid present in the unmodified starting protein are selected for replacement. In particular embodiments of the methods provided herein, the is-HIT amino acid positions are restricted, such that fewer than all amino acids on the protein-backbone are selected for amino acid replacement. In other embodiments, the replacing amino acids are restricted, such that fewer than all of the remaining 19 amino acids available to replace the native amino acid present in the unmodified starting protein are selected as replacing amino acids. In an exemplary embodiment, both of the scans to identify is-HIT amino acid positions and the replacing amino acids are restricted, such that fewer than all amino acids on the protein-backbone are selected for amino acid replacement and fewer than all of the remaining 19 amino acids available to replace the native amino acid are selected for replacement.

As used herein, "candidate LEADs," are mutant proteins that are contemplated as potentially having an alteration in any attribute, chemical, physical or biological property in which such alteration is sought. In the methods herein, candidate LEADs are generally generated by systematically replacing is-HITS loci in a protein or a domain thereof with typically a restricted subset, or all, of the remaining 19 amino acids, such as obtained using PAM analysis. Candidate LEADs can be generated by other methods known to those of skill in the art tested by the high throughput methods herein.

As used herein, "LEADs" are "candidate LEADs" whose activity has been demonstrated to be optimized or improved for the particular attribute, chemical, physical or biological property. For purposes herein a "LEAD" typically has activity with respect to the function of interest that differs by at least 10%, 20%, 30%, 40%, 50%, 60%, 70%, 80%, 90%, 100%, 150%, 200% or more from the unmodified and/or wild type (native) protein. In certain embodiments, the change in activity is at least about 5%, 10%, 15%, 20%, 25%, 30%, 35%, 40%, 45%, 50%, 55%, 60%, 65%, 70%, 75%, 80%, 85%, 90%, 95% or 100%, of the activity of the unmodified target protein. In other embodiments, the change in activity is not more than about 5%, 10%, 15%, 20%, 25%, 30%, 35%, 40%, 45%, 50%, 55%, 60%, 65%, 70%, 75%, 80%, 85%, 90%, 95% or 100% of the activity of the unmodified target protein. In yet other embodiments, the change in activity is at least about 2 times, 3 times, 4 times, 5 times, 6 times, 7 times, 8 times, 9 times, 10 times, 20 times, 30 times, 40 times, 50 times, 60 times, 70 times, 80 times, 90 times, 100 times, 200 times, 300 times, 400 times, 500 times, 600 times, 700 times, 800 times, 900 times, 1000 times, or more times greater than the activity of the unmodified target protein. The desired alteration, which can be either an increase or a decrease in activity, depends upon the function or property of interest (e.g., ~10%, ~20%, etc.). The LEADs can be further optimized by replacement of a plurality (2 or more) of "is-HIT" target positions on the same protein molecule to generate "super-LEADs."

As used herein, the term "super-LEAD" refers to protein mutants (variants) obtained by combining the single mutations present in two or more of the LEAD molecules into a single protein molecule. Accordingly, in the context of the modified proteins provided herein, the phrase "proteins containing one or more single amino acid replacements" encompasses any combination of two or more of the mutations described herein for a respective protein. For example, the modified proteins provided herein having one or more single amino acid replacements can have any combination of 2, 3, 4, 5, 6, 7, 8, 9, 10, 11, 12, 13, 14, 15, 16, 17, 18, 19, 20 or more of the amino acid replacements at the disclosed replacement positions. The collection of super-LEAD mutant molecules is generated, tested and phenotypically characterized one-by-one in addressable arrays. Super-LEAD mutant molecules contain a variable number and type of LEAD mutations. Molecules displaying further improved fitness for the particular feature being evolved are referred to as super-LEADs. Super-LEADs can be generated by other methods known to those of skill in the art and tested by the high throughput methods as described herein. A super-LEAD typically has activity with respect to the function of interest that differs from the improved activity of a LEAD by a desired amount, such as at least 10%, 20%, 30%, 40%, 50%, 60%, 70%, 80%, 90%, 100%, 150%, 200% or more from at least one of the LEAD mutants from which it is derived. As with LEADs, the change in the activity for super-LEADs is dependent upon the activity that is being "evolved." The desired alteration, which can be either an increase or a reduction in activity, depends upon the function or property of interest.

As used herein, a recitation that a modified growth hormone has more proliferative activity (or other activity) than anti-inflammation activity (or another activity) compared to the unmodified growth hormone, is comparing the absolute value of the change in each activity compared to an unmodified or native form.

As used herein, the phrase "altered loci" refers to the is-HIT amino acid positions in the LEADs or super-LEADs that are replaced with different replacing amino acids, resulting in the desired altered phenotype or activity.

As used herein, an "exposed residue" presents more than 15% of its surface exposed to the solvent.

As used herein, the phrase "structural homology" refers to the degree of coincidence in space between two or more protein backbones. Protein backbones that adopt the same protein structure, fold and show similarity upon three-dimensional structural superposition in space can be considered structurally homologous. Structural homology is not based on sequence homology, but rather, on three-dimension homology. Two amino acids in two different proteins said to be homologous based on structural homology between those proteins do not necessarily need to be in sequence-based homologous regions. For example, protein backbones that have a root mean squared (RMS) deviation of less than 3.5, 3.0, 2.5, 2.0, 1.7 or 1.5 angstroms (Å) at a given space position or defined region between each other can be considered to be structurally homologous in that region, and are referred to as having a "high coincidence" between their backbones. It is contemplated herein that substantially equivalent (e.g., "structurally-related") amino acid positions that are located on two or more different protein sequences that share a certain degree of structural homology have comparable functional tasks; and also are referred to herein as "structurally homologous loci." These two amino acids then can be said to be structurally similar or structurally-related with each other, even if their precise primary linear positions on the sequences of amino acids, when these sequences are aligned, do not match with each other. Amino acids that are structurally related can be far away from each other in the primary protein sequences, when these sequences are aligned following the rules of classical sequence homology. As used herein, a "structural homolog" is a protein that is generated by structural homology.

As used herein, "unmodified target polypeptide," "unmodified polypeptide," "unmodified cytokine," "unmodified GH," "unmodified growth hormone" or grammatical variations thereof, refer to a starting polypeptide (protein) that is selected for modification using the methods provided herein. The starting unmodified target polypeptide can be the naturally occurring, wild type form of a protein. In addition, the starting unmodified target polypeptides previously can have been altered or mutated, such that they differ from the native wild-type isoform, but are nonetheless referred to herein as starting unmodified target polypeptides relative to the subsequently modified polypeptides produced herein. Thus, existing polypeptides known in the art that have previously been modified to have a desired increase or decrease in a particular activity compared to an unmodified reference protein can be selected and used herein as the starting "unmodified target protein." For example, a polypeptide that has been modified from its native form by one or more single amino acid changes and possesses either an increase or decrease in a desired activity, such as resistance to proteolysis, can be utilized with the methods provided herein as the starting unmodified target polypeptide for further modification of either the same or a different activity.

Likewise, existing polypeptides known in the art that previously have been modified to have a desired alternation, such as an increase or decrease, in a particular activity compared to an unmodified or reference protein can be selected and used as provided herein for identification of structurally homologous loci on other structurally homologous target polypeptides. For example, a polypeptide that has been modified by one or more single amino acid changes and possesses either an increase or decrease in a desired activity (e.g., resistance to proteolysis) can be utilized with the methods provided herein to identify on structurally homologous target polypeptides, corresponding structurally homologous loci that can be replaced with suitable replacing amino acids and tested for either an increase or decrease in a desired or selected activity.

As used herein, a "variant" or "growth hormone variant" or "modified growth hormone," refers to a growth hormone polypeptide that has one or more mutations compared to an unmodified GH polypeptide. The one or more mutations can be one or amino acid replacements, insertions, deletions and/or any combination thereof.

As used herein, "in a position or positions corresponding to an amino acid position" of a protein refers to amino acid positions that are determined to correspond to one another based on sequence and/or structural alignments with a specified reference protein. For example, in a position corresponding to an amino acid position of human growth hormone set forth as SEQ ID NO: 1 can be determined empirically by aligning the sequence of amino acids set forth in SEQ ID NO: 1 with a particular GH polypeptide of interest. Corresponding positions can be determined by such alignment by one of skill in the art using manual alignments or by using the numerous alignment programs available (for example, BLASTP). Corresponding positions also can be based on structural alignments, for example, by using computer simulated alignments of protein structure. Recitation that amino acids of a polypeptide correspond to amino acids in a disclosed sequence refers to amino acids identified upon alignment of the polypeptide with the disclosed sequence to maximize identity or homology (where conserved amino acids are aligned) using a standard alignment algorithm, such as the GAP algorithm. As used herein, "at a position corresponding to" refers to a position of interest (i.e., base number or residue number) in a nucleic acid molecule or protein relative to the position in another reference nucleic acid molecule or protein. The position of interest to the position in another reference protein can be in, for example, a precursor protein, an allelic variant, a heterologous protein, an amino acid sequence from the same protein of another species, etc. Corresponding positions can be determined by comparing and aligning sequences to maximize the number of matching nucleotides or residues. For example, identity between the sequences can be greater than 95%, greater than 96%, greater than 97%, greater than 98% and more particularly greater than 99%. The position of interest is then given the number assigned in the reference nucleic acid molecule or polypeptide sequence. One of skill in the art would understand that for a modified GH polypeptide compared to a mature unmodified GH polypeptide, amino acid residue 1 of the modified polypeptide corresponds to amino acid residue 1 of the mature unmodified GH polypeptide. One of skill in the art would also understand that for a modified precursor GH polypeptide compared to a precursor unmodified GH polypeptide, amino acid residue 1 of the modified polypeptide corresponds to amino acid residue 1 of the unmodified GH polypeptide. Additionally, amino acid residue 27 of the modified precursor GH polypeptide corresponds to amino acid residue 1 of a mature unmodified GH polypeptide due to the presence of the 26 amino acid signal sequence of the precursor polypeptide. Thus, one of skill in the art can determine the "corresponding" amino acid residues in modified and unmodified GH polypeptides.

As used herein, the terms "homology" and "identity" are used interchangeably but homology for proteins can include conservative amino acid changes. In general to identify corresponding positions the sequences of amino acids are aligned so that the highest order match is obtained (see, for example,: *Computational Molecular Biology*, Lesk, A. M., ed., Oxford University Press, New York, 1988; *Biocomputing: Informatics and Genome Projects*, Smith, D. W., ed., Academic Press, New York, 1993; *Computer Analysis of Sequence Data*, Part I, Griffin, A. M., and Griffin, H. G., eds., Humana Press, New Jersey, 1994; *Sequence Analysis in Molecular Biology*, von Heinje, G., Academic Press, 1987; and *Sequence Analysis Primer*, Gribskov, M. and Devereux, J., eds., M Stockton Press, New York, 1991; Carillo et al. *SIAM J. Applied Math* 48: 1073 (1988)).

As use herein, "sequence identity" refers to the number of identical amino acids (homology includes conservative amino acid substitutions as well). Sequence identity can be determined by standard alignment algorithm programs, and used with default gap penalties established by each supplier. Substantially homologous nucleic acid molecules would hybridize typically at moderate stringency or at high stringency all along the length of the nucleic acid or along at least about 70%, 80% or 90% of the full length nucleic acid molecule of interest. Also contemplated are nucleic acid molecules that contain degenerate codons in place of codons in the hybridizing nucleic acid molecule. (For proteins, for determination of homology conservative amino acids can be aligned as well as identical amino acids; in this case percentage of identity and percentage homology vary). Whether any two nucleic acid molecules have nucleotide sequences that are at least 80%, 85%, 90%, 95%, 96%, 97%, 98% or 99% "identical" can be determined using known computer algorithms such as the "FAST A "program," using for example, the default parameters as in Pearson et al. *Proc. Natl. Acad. Sci. USA* 85: 2444 (1988) (other programs include the GCG program package (Devereux, J., et al., *Nucleic Acids Research* 12(I): 387 (1984)), BLASTP, BLASTN, FASTA (Atschul, S. F., et al., *J. Molec. Biol.* 215: 403 (1990); *Guide to Huge Computers*, Martin J. Bishop, ed., Academic Press, San Diego, 1994, and Carillo et al. *SIAM J. Applied Math* 48: 1073 (1988)). For example, the BLAST function of the National Center for Biotechnology Information database can be used to determine identity. Other commercially or publicly available programs include, DNAStar" "MegAlign" program (Madison, Wis.) and the University of Wisconsin Genetics Computer Group (UWG) "Gap" program (Madison Wis.)). Percent homology or identity of proteins and/or nucleic acid molecules can be determined, for example, by comparing sequence information using a GAP computer program (e.g., Needleman et al. *J. Mol. Biol.* 48: 443 (1970), as revised by Smith and Waterman (*Adv. Appl. Math.* 2: 482 (1981)). Briefly, a GAP program defines similarity as the number of aligned symbols (i.e., nucleotides or amino acids) which are similar, divided by the total number of symbols in the shorter of the two sequences. Default parameters for the GAP program can include: (1) a unary comparison matrix (containing a value of 1 for identities and 0 for non identities) and the weighted comparison matrix of Gribskov et al. *Nucl. Acids Res.* 14: 6745 (1986), as described by Schwartz and Dayhoff, eds., *ATLAS OF PROTEIN SEQUENCE AND STRUCTURE*, National Biomedical Research Foundation, pp. 353-358 (1979); (2) a penalty of 3.0 for each gap and an additional 0.10 penalty for each symbol in each gap; and (3) no penalty for end gaps. Therefore, as used herein, the term "identity" represents a comparison between a test and a reference polypeptide or polynucleotide.

As used herein, the term ""at least 90% identical to" refers to percent identities from 90 to 100% relative to the reference polypeptides. Identity at a level of 90% or more is indicative of the fact that, assuming for exemplification purposes a test and reference polynucleotide length of 100 amino acids are compared, no more than 10% (i.e., 10 out of 100) of amino acids in the test polypeptide differs from that of the reference polypeptides. Similar comparisons can be made between a test and reference polynucleotides. Such differences can be represented as point mutations randomly distributed over the entire length of an amino acid sequence or they can be clustered in one or more locations of varying length up to the maximum allowable, e.g., 10/100 amino acid difference (approximately 90% identity). Differences are defined as nucleic acid or amino acid substitutions, insertions or deletions. At the level of homologies or identities above about 85-90%, the result should be independent of the program and gap parameters set; such high levels of identity can be assessed readily, often without relying on software.

As used herein, a "single amino acid replacement" refers to the replacement of one amino acid by another amino acid. The replacement can be by a natural amino acid or non-natural amino acids. When one amino acid is replaced by another amino acid in a protein, the total number of amino acids in the protein is unchanged.

As used herein, the phrase "only one amino acid replacement occurs on each target protein" refers to the modification of a target protein, such that it differs from the unmodified form of the target protein by a single amino acid change. For example, in one embodiment, mutagenesis is performed by the replacement of a single amino acid residue at only one is-HIT target position on the protein backbone (e.g., "one-by-one" in addressable arrays), such that each individual mutant generated is the single product of each single mutagenesis reaction. The single amino acid replacement mutagenesis reactions are repeated for each of the replacing amino acids selected at each of the is-HIT target positions. Thus, a plurality of mutant protein molecules are produced, whereby each mutant protein contains a single amino acid replacement at only one of the is-HIT target positions.

As used herein, the phrase "pseudo-wild type," in the context of single or multiple amino acid replacements, are those amino acids that, while different from the original, such as native, amino acid at a given amino acid position, can replace the native one at that position without introducing any measurable change in a particular protein activity. A population of sets of nucleic acid molecules encoding a collection of mutant molecules is generated and phenotypically characterized such that proteins with sequences of amino acids different from the original amino acid, but that still elicit substantially the same level (i.e., at least 10%, 50%, 70%, 90%, 95%, 100%, depending upon the protein) and type of desired activity as the original protein are selected.

As used herein, "a naked polypeptide chain" refers to a polypeptide that is not post-translationally modified or otherwise chemically modified, and only contains covalently linked amino acids.

As used herein, a "polypeptide complex" includes polypeptides produced by chemical modification or post-translational modification. Such modifications include, but are not limited to, pegylation, albumination, glycosylation, farnysylation, phosphorylation and/or other polypeptide modifications known in the art.

As used herein, "output signal" refers to parameters that can be followed over time and, if desired, quantified. For example, when a recombinant protein is introduced into a cell, the cell containing the recombinant protein undergoes a number of changes. Any such change that can be monitored and used to assess the transformation or transfection, is an output signal, and the cell is referred to as a reporter cell; the encoding nucleic acid is referred to as a reporter gene, and the construct that includes the encoding nucleic acid is a reporter construct. Output signals include, but are not limited to, enzyme activity, fluorescence, luminescence, amount of product produced and other such signals. Output signals include expression of a gene or gene product, including heterologous genes (transgenes) inserted into the plasmid virus. Output signals are a function of time ("t") and are related to the amount of protein used in the composition. For higher concentrations of protein, the output signal can be higher or lower. For any particular concentration, the output signal increases as a function of time until a plateau is reached. Output signals also can measure the interaction between cells, expressing heterologous genes, and biological agents.

As used herein, the Hill equation is a mathematical model that relates the concentration of a drug (i.e., test compound or substance) to the response measured $$y = \frac{y_{max}[D]^x}{[D]^n + [D_{50}]^n}$$

where y is the variable measured, such as a response, signal, $y_{max}$ is the maximal response achievable, [D] is the molar concentration of a drug, [$D_{50}$] is the concentration that produces a 50% maximal response to the drug, n is the slope parameter, which is 1 if the drug binds to a single site and with no cooperativity between or among sites. A Hill plot is $\log_{10}$ of the ratio of ligand-occupied receptor to free receptor vs. log [D] (M). The slope is n, where a slope of greater than 1 indicates cooperativity among binding sites, and a slope of less than 1 can indicate heterogeneity of binding. This equation has been employed in methods for assessing interactions in complex biological systems (see, published International PCT application No. WO 01/44809 based on PCT No. PCT/FR00/03503).

As used herein, in the Hill-based analysis (published International PCT application No. WO 01/44809 based on PCT No. PCT/FR00/03503), the parameters, $\pi, \kappa, \tau, \epsilon, \eta, \theta$, are as follows:

$\pi$ is the potency of the biological agent acting on the assay (cell-based) system;

$\kappa$ is the constant of resistance of the assay system to elicit a response to a biological agent;

$\epsilon$ is the global efficiency of the process or reaction triggered by the biological agent on the assay system;

$\tau$ is the apparent titer of the biological agent;

$\theta$ is the absolute titer of the biological agent; and $\eta$ is the heterogeneity of the biological process or reaction.

In particular, as used herein, the parameters $\pi$ (potency) or $\kappa$ (constant of resistance) are used to respectively assess the potency of a test agent to produce a response in an assay system and the resistance of the assay system to respond to the agent.

As used herein, $\epsilon$ (efficiency), is the slope at the inflexion point of the Hill curve (or, in general, of any other sigmoidal or linear approximation), to assess the efficiency of the global reaction (the biological agent and the assay system taken together) to elicit the biological or pharmacological response.

As used herein, $\tau$ (apparent titer) is used to measure the limiting dilution or the apparent titer of the biological agent.

As used herein, $\theta$ (absolute titer), is used to measure the absolute limiting dilution or titer of the biological agent.

As used herein, $\eta$ (heterogeneity) measures the existence of discontinuous phases along the global reaction, which is reflected by an abrupt change in the value of the Hill coefficient or in the constant of resistance.

As used herein, a "population of sets of nucleic acid molecules encoding a library (collection) of mutants" refers to a library of plasmids or other vehicles that carry (encode) the gene variants, such that individual plasmids or other individual vehicles carry individual gene variants. Each element (member) of the library is physically separated from the others, such as individually in an appropriate addressable array, and has been generated as the single product of an independent mutagenesis reaction. When a library of such proteins is contemplated, it will be so-stated.

As used herein, a "reporter cell" is the cell that "reports," i.e., undergoes the change, in response to a condition, such as, for example, exposure to a protein or a virus or to a change it its external or internal environment.

As used herein, "reporter" or "reporter moiety" refers to any moiety that allows for the detection of a molecule of interest, such as a protein expressed by a cell. Reporter moieties include, but are not limited to, for example, fluorescent proteins, such as red, blue and green fluorescent proteins, LacZ and other detectable proteins and gene products. For expression in cells, a nucleic acid molecule encoding the reporter moiety can be expressed as a fusion protein with a protein of interest or under to the control of a promoter of interest.

As used herein, "phenotype" refers to the physical, physiological or other manifestation of a genotype (a sequence of a gene). In methods herein, phenotypes that result from alteration of a genotype are assessed.

As used herein, "activity" means in the largest sense of the term any change in a system (either biological, chemical or physical system) of any nature (changes in the amount of product in an enzymatic reaction, changes in cell proliferation, in immunogenicity, in toxicity) caused by a protein or protein mutant when they interact with that system. In addition, the terms "activity," "higher activity" or "lower activity" as used herein in reference to resistance to proteases, proteolysis, incubation with serum or with blood, means that the ratio or a residual activity (such as cell proliferation) between "after" protease/blood or serum treatment and "before" protease/blood or serum treatment.

As used herein, "activity" refers to the function or property to be evolved. An active site refers to a site(s) responsible or that participates in conferring the activity or function. The activity or active site evolved (the function or property and the site conferring or participating in conferring the activity) can have nothing to do with natural activities of a protein. For example, it could be an "active site" for conferring immunogenicity (immunogenic sites or epitopes) on a protein.

As used herein, "activity," and "pharmacological activity" refer to any activity (in vitro or in vivo) of a polypeptide provided herein, including, but not limited to, resistance to proteolysis, biological efficiency, transduction efficiency, gene/transgene expression, differential gene expression and induction activity, titer, progeny productivity, toxicity, cytotoxicity, immunogenicity, cell proliferation and/or differentiation activity, morphogenetic activity, therapeutic activity, increased muscle mass, pharmacological activity, cell/tissue tropism and delivery.

As used herein, a modified GH polypeptide retains at least 1%, 2%, 3%, 4%, 5%, 6%, 7%, 8%, 9%, 10%, . . . 20%, . . . 30%, . . . 40%, . . . 50%, . . . 60%, . . . 70%. . . . 80%, . . . 90%, . . . 95%, 96%, 97%, 98% or at least 99% of the activity of the unmodified GH polypeptide. The change can be at least about 2 times, 3 times, 4 times, 5 times, 6 times, 7 times, 8 times, 9 times, 10 times, 20 times, 30 times, 40 times, 50 times, 60 times, 70 times, 80 times, 90 times, 100 times, 200 times, 300 times, 400 times, 500 times, 600 times, 700 times, 800 times, 900 times, 1000 times, or more times greater than unmodified GH. Activity can be measured, for example, using assays such as those described in the Examples below.

As used herein, the amino acids, which occur in the various sequences of amino acids provided herein, are identified according to their known, three-letter or one-letter abbreviations (see, Table 1). The nucleotides, which occur in the various nucleic acid fragments, are designated with the standard single-letter designations used routinely in the art.

As used herein, an amino acid is an organic compound containing an amino group and a carboxylic acid group. A polypeptide contains two or more amino acids. For purposes herein, amino acids include the twenty naturally-occurring amino acids non-natural amino acids, and amino acid analogs. These include amino acids wherein α-carbon has a side chain.

As used herein, the abbreviations for any protective groups, amino acids and other compounds, are, unless indicated otherwise, in accord with their common usage, recognized abbreviations, or the IUPAC-IUB Commission on Biochemical Nomenclature, *Biochem.* 11: 1726 (1972)). Each naturally occurring L-amino acid is identified by the standard three letter code (or single letter code) or the standard three letter code (or single letter code) with the prefix "L-;" the prefix "D-" indicates that the stereoisomeric form of the amino acid is D.

As used herein, amino acid residue refers to an amino acid formed upon chemical digestion (hydrolysis) of a polypeptide at its peptide linkages. The amino acid residues described herein are presumed to be in the "L" isomeric form. Residues in the "D" isomeric form, which are so designated, can be substituted for any L-amino acid residue, as long as the desired functional property is retained by the polypeptide. $NH_2$ refers to the free amino group present at the amino terminus of a polypeptide. COOH refers to the free carboxy group present at the carboxyl terminus of a polypeptide. In keeping with standard polypeptide nomenclature described in *J. Biol. Chem.*, 243: 3552-3559 (1969), and adopted 37 C.F.R. §§1.821-1.822, abbreviations for amino acid residues are shown in Table 1:

TABLE 1

Table of Correspondence

| SYMBOL | | |
|---|---|---|
| 1-Letter | 3-Letter | AMINO ACID |
| Y | Tyr | tyrosine |
| G | Gly | glycine |
| F | Phe | phenylalanine |
| M | Met | methionine |
| A | Ala | alanine |
| S | Ser | serine |
| I | Ile | isoleucine |
| L | Leu | leucine |
| T | Thr | threonine |
| V | Val | valine |
| P | Pro | proline |
| K | Lys | lysine |
| H | His | histidine |
| Q | Gln | glutamine |
| E | Glu | glutamic acid |
| Z | Glx | Glu and/or Gln |
| W | Trp | tryptophan |
| R | Arg | arginine |
| D | Asp | aspartic acid |
| N | Asn | asparagine |
| B | Asx | Asn and/or Asp |
| C | Cys | cysteine |
| X | Xaa | Unknown or other |

It should be noted that all amino acid residue sequences represented herein by formulae have a left to right orientation in the conventional direction of amino-terminus to carboxyl-terminus. In addition, the phrase "amino acid residue" is broadly defined to include the amino acids listed in the Table of Correspondence (Table 1) and modified and unusual amino acids, such as those referred to in 37 C.F.R. §§1.821-1.822, and incorporated herein by reference. Furthermore, it should be noted that a dash at the beginning or end of an amino acid residue sequence indicates a peptide bond to a further sequence of one or more amino acid residues or to an amino-terminal group such as $NH_2$ or to a carboxyl-terminal group such as COOH.

As used herein, "naturally-occurring" amino acids refer to the 20 L-amino acids that occur in polypeptides.

As used herein, the term "non-natural amino acid" refers to an organic compound that has a structure similar to a natural amino acid but has been modified structurally to mimic the structure and reactivity of a natural amino acid. Non-naturally occurring amino acids, thus, include amino acids or analogs of amino acids other than the 20 naturally-occurring amino acids and include, but are not limited to, the D-isostereomers of amino acids. Exemplary non-natural amino acids are described herein and are known to those of skill in the art.

As used herein, nucleic acids include DNA, RNA and analogs thereof, including protein nucleic acids (PNA) and mixture thereof. Nucleic acids can be single-stranded or double-stranded. Single-stranded molecules are contemplated when referring to probes or primers which can be optionally labeled with a detectable label, such as a fluorescent or radiolabel. Such molecules are typically of a length such that they are statistically unique of low copy number (typically less than 5, generally less than 3) for probing or priming a library. Generally a probe or primer contains at least 14, 16 or 30 contiguous of sequence complementary to, or identical to, a gene of interest. Probes and primers can be 10, 14, 16, 20, 30, 50, 100 or more nucleic acid bases long.

As used herein, "corresponding structurally-related" positions on two or more proteins, such as GH protein and other cytokines, refers to those amino acid positions determined based upon structural homology to maximize tri-dimensional overlapping between proteins.

As used herein, the term "identity" represents a comparison between a test and a reference polypeptide or polynucleotide. For example, a test polypeptide can be defined as any polypeptide that is 90% or more identical to a reference polypeptide.

As used herein, the term at least "90% identical to" refers to percent identities from 90 to 100% relative to the reference polypeptides. Identity at a level of 90% or more is indicative of the fact that, assuming for exemplification purposes a test and reference polypeptide length of 100 amino acids are compared. No more than 10% (i.e., 10 out of 100) amino acids in the test polypeptide differ from that of the reference polypeptides. Similar comparisons can be made between test and reference polynucleotides. Such differences can be represented as point mutations randomly distributed over the entire length of an sequence of amino acids or they can be clustered in one or more locations of varying length up to the maximum allowable, e.g., 10/100 amino acid difference (approximately 90% identity). Differences are defined as nucleic acid or amino acid substitutions, or deletions.

As used herein, the phrase "sequence-related proteins" refers to proteins that have at least 50%, at least 60%, at least 70%, at least 80%, at least 90% or at least 95% amino acid identity or homology with each other.

As used herein, families of non-related proteins or "sequence-non-related proteins" refers to proteins that have less than 50%, less than 40%, less than 30% or less than 20% amino acid identity or homology with each other.

As used herein, it also is understood that the terms ""substantially identical"" or "similar" varies with the context as understood by those skilled in the relevant art.

As used herein, heterologous or foreign nucleic acid, such as DNA and RNA, are used interchangeably and refer to DNA or RNA that do not occur naturally as part of the genome in which it is present or is found at a locus or loci in a genome that differs from that in which it occurs in nature. Heterologous nucleic acid includes nucleic acid not endogenous to the cell into which it is introduced, but that has been obtained from another cell or prepared synthetically. Generally, although not necessarily, such nucleic acid encodes RNA and proteins that are not normally produced by the cell in which it is expressed. Heterologous DNA herein encompasses any DNA or RNA that one of skill in the art would recognize or consider as heterologous or foreign to the cell or locus in or at which it is expressed. Heterologous DNA and RNA also can encode RNA or proteins that mediate or alter expression of endogenous DNA by affecting transcription, translation, or other regulatable biochemical processes. Examples of heterologous nucleic acid include, but are not limited to, nucleic acid that encodes traceable marker proteins, such as a protein that confers drug resistance, nucleic acid that encodes therapeutically effective substances, such as anti-cancer agents, enzymes and hormones, and DNA that encodes other types of proteins, such as antibodies.

Hence, herein "heterologous DNA" or "foreign DNA," includes a DNA molecule not present in the exact orientation and position as the counterpart DNA molecule found in the genome. It also can refer to a DNA molecule from another organism or species (i.e., exogenous).

As used herein, "isolated with reference to a nucleic acid molecule or polypeptide or other biomolecule" means that the nucleic acid or polypeptide has separated from the genetic environment from which the polypeptide or nucleic acid were obtained. It also can mean altered from the natural state. For example, a polynucleotide or a polypeptide naturally present in a living animal is not "isolated," but the same polynucleotide or polypeptide separated from the coexisting materials of its natural state is "isolated," as the term is employed herein. Thus, a polypeptide or polynucleotide produced and/or contained within a recombinant host cell is considered isolated. Also intended as an "isolated polypeptide" or an "isolated polynucleotide" are polypeptides or polynucleotides that have been purified, partially or substantially, from a recombinant host cell or from a native source. For example, a recombinantly produced version of a compound can be substantially purified by the one-step method described in Smith et al., Gene, 67: 31-40 (1988). The terms isolated and purified are sometimes used interchangeably.

Thus, by "isolated" it is meant that the nucleic acid is free of coding sequences of those genes that, in the naturally-occurring genome of the organism (if any) immediately flank the gene encoding the nucleic acid of interest. Isolated DNA can be single-stranded or double-stranded, and can be genomic DNA, cDNA, recombinant hybrid DNA, or synthetic DNA. It can be identical to a starting DNA sequence, or can differ from such sequence by the deletion, addition, or substitution of one or more nucleotides.

"Isolated" or "purified" as it refers to preparations made from biological cells or hosts means any cell extract containing the indicated DNA or polypeptide including a crude extract of the DNA or polypeptide of interest. In the case of a polypeptide, for example, a purified preparation can be obtained following an individual technique or a series of preparative or biochemical techniques and the DNA or polypeptide of interest can be present at various degrees of purity in these preparations. The procedures can include for example, but are not limited to, ammonium sulfate fractionation, gel filtration, ion exchange chromatography, affinity chromatography, density gradient centrifugation and electrophoresis.

A preparation of DNA or protein that is "substantially pure" or "isolated" should be understood to mean a preparation free from naturally occurring materials with which such DNA or protein is normally associated in nature. "Essentially pure" should be understood to mean a "highly" purified preparation that contains at least 95% of the DNA or protein of interest.

A cell extract that contains the DNA or protein of interest should be understood to mean a homogenate preparation or cell-free preparation obtained from cells that express the protein or contain the DNA of interest. The term "cell extract" is intended to include culture media, especially spent culture media from which the cells have been removed.

As used herein, "a targeting agent" refers to any molecule that can bind to another target-molecule, such as an antibody, receptor, or ligand.

As used herein, a "receptor" refers to a molecule that specifically binds to (or with) other molecules. A receptor refers to a molecule that has an affinity for a particular ligand. Receptors include naturally-occurring and synthetic molecules. Receptors also are referred to in the art as anti-ligands.

Receptors can be used or occur or are active in their unaltered state or bound to other polypeptides, including as homodimers and as heterodimers. Receptors can be attached to, covalently or noncovalently, or in physical contact with, a binding member, either directly or indirectly via a specific binding substance or linker. Examples of receptors, include, but are not limited to cell membrane receptors, cell surface receptors and internalizing receptors.

As used herein, "recombinant" refers to any progeny formed as the result of genetic engineering.

As used herein, a "promoter region" refers to the portion of DNA of a gene that controls transcription of the DNA to which it is operatively linked. The promoter region includes specific sequences of DNA sufficient for RNA polymerase recognition, binding and transcription initiation. This portion of the promoter region is referred to as the "promoter." In addition, the promoter region includes sequences that modulate this recognition, binding and transcription initiation activity of the RNA polymerase. Promoters, depending upon the nature of the regulation, can be constitutive or regulated by cis acting or trans acting factors.

As used herein, the phrase "operatively linked" generally means the sequences or segments have been covalently joined into one piece of DNA, whether in single- or double-stranded form, whereby control or regulatory sequences on one segment control or permit expression or replication or other such control of other segments. The two segments are not necessarily contiguous. For gene expression, a DNA sequence and a regulatory sequence(s) are connected in such a way to control or permit gene expression when the appropriate molecular, e.g., transcriptional activator proteins, are bound to the regulatory sequence(s).

As used herein, production by recombinant means by using recombinant DNA methods means the use of the well known methods of molecular biology for expressing proteins encoded by cloned DNA, including cloning expression of genes and methods, such as gene shuffling and phage display with screening for desired specificities.

As used herein, a "splice variant" refers to a variant nucleic acid molecule produced by differential processing of a primary transcript of genomic DNA that results in more than one type of mRNA. Splice variants also refer to the encoded polypeptide. It will be clear from the context whether a nucleic acid molecule or polypeptide is intended.

As used herein, a "composition" refers to any mixture of two or more products or compounds. It includes, a solution, a suspension, liquid, powder, a paste, aqueous, non-aqueous and combinations thereof.

As used herein, an "article of manufacture" is a product that is made and sold. As used throughout this application, the term is intended to encompass modified growth hormone polypeptides and nucleic acids contained in articles of packaging.

As used herein, a "combination" refers to any association between two or more items. For example, a combination includes f a modified growth hormone polypeptide and/or nucleic acid molecule provided herein and another item for a purpose including, but not limited to, administration, diagnosis, and assessment of an activity or property.

As used herein, a "kit" refers to a packaged combination, with optional instructions for use and/or reagents and vials for use.

As used herein, "substantially identical to" a product means sufficiently similar so that the property of interest is sufficiently unchanged so that the substantially identical product can be used in place of the product.

As used herein, "vector" refers to a nucleic acid molecule capable of transporting another nucleic acid to which it has been linked. One type of exemplary vector is an episome, i.e., a nucleic acid capable of extra-chromosomal replication. Exemplary vectors are those capable of autonomous replication and/or expression of nucleic acids to which they are linked; such vectors typically include origins of replication. Vectors also can be designed for integration into host chromosomes. Vectors capable of directing the expression of genes to which they are operatively linked are referred to herein as "expression vectors." Expression vectors are often in the form of "plasmids," which refer generally to circular double-stranded DNA loops which, in their vector form are not bound to the chromosome. "Plasmid" and "vector" are used interchangeably as the plasmid is the most commonly used form of vectors.

As used herein, vector also include "virus vectors" or "viral vectors." Viral vectors are engineered viruses that are operatively linked to exogenous genes to transfer (as vehicles or shuttles) the exogenous genes into cells.

As used herein, "allele," which is used interchangeably herein with "allelic variant" refers to alternative forms of a gene or portions thereof. Alleles occupy the same locus or position on homologous chromosomes. When a subject has two identical alleles of a gene, the subject is said to be homozygous for the gene or allele. When a subject has two different alleles of a gene, the subject is said to be heterozygous for the gene. Alleles of a specific gene can differ from each other in a single nucleotide, or several nucleotides, and can include substitutions, deletions, and insertions of nucleotides. An allele of a gene also can be a form of a gene containing a mutation.

As used herein, the term "gene" or "recombinant gene" refers to a nucleic acid molecule containing an open reading frame and including at least one exon and optionally an intron-encoding sequence. A gene can be either RNA or DNA. Genes can include regions preceding and following the coding region (leader and trailer). As used herein, "intron" refers to a DNA sequence present in a given gene which is spliced out during mRNA maturation. As used herein, the term "coding sequence" refers to that portion of a gene that encodes a sequence of amino acids present in a protein.

As used herein, "nucleotide sequence complementary to the nucleotide sequence encoding the amino acid sequence set forth in SEQ ID NO:" refers to the nucleotide sequence of the complementary strand of a nucleic acid strand encoding an amino acid sequence having the particular SEQ ID NO:. The term "complementary strand" is used herein interchangeably with the term "complement." The complement of a nucleic acid strand can be the complement of a coding strand or the complement of a non-coding strand. When referring to double-stranded nucleic acids, the complement of a nucleic acid encoding an amino acid sequence having a particular SEQ ID NO: refers to the complementary strand of the strand encoding the amino acid sequence set forth in the particular SEQ ID NO: or to any nucleic acid having the nucleotide sequence of the complementary strand of the particular nucleic acid sequence. When referring to a single-stranded nucleic acid having a nucleotide sequence, the complement of this nucleic acid is a nucleic acid having a nucleotide sequence which is complementary to that of the particular nucleic acid sequence.

As used herein, the term "sense strand" refers to that strand of a double-stranded nucleic acid molecule that has the sequence of the mRNA that encodes the sequence of amino acids encoded by the double-stranded nucleic acid molecule.

As used herein, the term "antisense strand" refers to that strand of a double-stranded nucleic acid molecule that is the complement of the sequence of the mRNA that encodes the sequence of amino acids encoded by the double-stranded nucleic acid molecule.

As used herein, an "array" refers to a collection of elements, such as nucleic acid molecules, containing three or more members. An addressable array is one in which the members of the array are identifiable, typically by position on a solid phase support or by virtue of an identifiable or detectable label, such as by color, fluorescence, electronic signal (i.e., RF, microwave or other frequency that does not substantially alter the interaction of the molecules of interest), bar code or other symbology, chemical or other such label. In certain embodiments, the members of the array are immobilized to discrete identifiable loci on the surface of a solid phase or directly or indirectly linked to or otherwise associated with the identifiable label, such as affixed to a microsphere or other particulate support (herein referred to as beads) and suspended in solution or spread out on a surface.

As used herein, a "support" (also referred to as a matrix support, a matrix, an insoluble support or solid support) refers to any solid or semisolid or insoluble support to which a molecule of interest, typically a biological molecule, organic molecule or biospecific ligand is linked or contacted. Such materials include any materials that are used as affinity matrices or supports for chemical and biological molecule syntheses and analyses, such as, but are not limited to: polystyrene, polycarbonate, polypropylene, nylon, glass, dextran, chitin, sand, pumice, agarose, polysaccharides, dendrimers, buckyballs, polyacryl-amide, silicon, rubber, and other materials used as supports for solid phase syntheses, affinity separations and purifications, hybridization reactions, immunoassays and other such applications. The matrix herein can be particulate or can be in the form of a continuous surface, such as a microtiter dish or well, a glass slide, a silicon chip, a nitrocellulose sheet, nylon mesh, or other such materials. When particulate, typically the particles have at least one dimension in the 5-10 mm range or smaller. Such particles, referred collectively herein as "beads," are often, but not necessarily, spherical. Such reference, however, does not constrain the geometry of the matrix, which can be any shape, including random shapes, needles, fibers, and elongated. Roughly spherical beads, particularly microspheres that can be used in the liquid phase, also are contemplated. The beads can include additional components, such as magnetic or paramagnetic particles (see, e.g., Dynabeads (Dynal, Oslo, Norway)) for separation using magnets, as long as the additional components do not interfere with the methods and analyses herein.

As used herein, a "matrix" or "support particle" refers to matrix materials that are in the form of discrete particles. The particles have any shape and dimension, but typically have at least one dimension that is 100 mm or less, 50 mm or less, 10 mm or less, 1 mm or less, 100 µm or less, 50 µm or less and typically have a size that is 100 mm$^3$ or less, 50 mm$^3$ or less, 10 mm$^3$ or less, and 1 mm$^3$ or less, 100 µm$^3$ or less and can be order of cubic microns. Such particles are collectively called "beads."

As used herein, the abbreviations for any protective groups, amino acids and other compounds, are, unless indicated otherwise, in accord with their common usage, recognized abbreviations, or the IUPAC-IUB Commission on Biochemical Nomenclature *Biochem.* 11: 942-944 (1972).

B. Growth Hormone

Growth hormone (GH), also known as somatotropin, is a peptide hormone produced in animals, including mammals. GH is a member of the cytokine family of proteins that is produced by somatotrophic cells of the anterior pituitary. GH plays a role in somatic growth through effects on metabolism of proteins, carbohydrates and lipids. GH also is produced in the placenta. Placental GH plays a role in modulating maternal and fetal metabolism. Pituitary growth hormone is a somatotropic hormone secreted from the anterior pituitary gland. The release of growth hormone (GH) is regulated by growth hormone-releasing hormone (GHRH) secreted from the hypothalamus (See, for example Ascoli et al. (1996) "Adenohypophyseal hormones and their hypothalamic releasing factors Goodman & Gilman's *The Pharmacological Basis of Therapeutics*, Hardman et al. eds) pp. 1363-1382, McGraw-Hill, New York). Growth hormone is released in an episodic and pulsatile fashion (See, for example Brook et al. *Endocrinol. Metab. Clin. North Am.* 21: 767-782 (1992)).

Growth hormone has been studies in humans and other mammals. Pharmacodynamic responses to GH have been studies in humans. These responses fall under two categories: 1) immediate responses that include production of insulin-like growth factors I and II (IGF-1 and IGF-2), stimulation of triglyceride hydrolysis in adipose tissues, and stimulation of hepatic glucose output; and 2) intermediate responses of hGH that include anabolism and growth promotion mediated by IGF-I, including chondrogenesis, skeletal growth, and growth of soft tissues (Ascoli et al., 1996).

The liver is the major organ producing IGF-I. Hepatic IGF-I induction is dependent upon hGH exposure by increasing transcription of IGF-I mRNA (see, for example, Mathews L S, Norstedt G and Palmiter R D *Proc. Natl. Acad. Sci. USA* 83: 9343-9347 (1986)). The major form of IGF-I in the circulation is a 150-kDa complex associated with a 40-kDa insulin-like growth factor binding protein 3 (IGFBP-3) and an 85-kDa acid-labile subunit (see, for example, Baxter et al. *J. Biol. Chem.* 264: 11843-11848 (1989)). This complex circulating in the plasma serves to transport IGF-I from liver into effect sites for growth promotion. Overall, GH plays a major role in the regulation of IGF-I, IGFBP-3, and acid-labile subunit (see, for example, Kupfer et al. *J. Clin. Invest.* 91: 391-396 (1993)).

1. Growth Hormone Structure

GH polypeptides are single domain proteins composed of a helical bundle composed of four alpha-helices (A, B, C and D), which are connected by four interhelical loops (AB, BC, CD and DE). Disulfide bridges can further stabilize GH structure. For example, human growth hormone isoforms possess two disulfide bridges (cysteines 53-165 and 182-189 of the mature chain). These two bridges link the loops AB and DE to each other. The presence of disulfide bridges appears to contribute to stability and productive binding with the receptor.

Growth hormone polypeptides from different species share conserved sequences of amino acids (see for example, Abdel-Meguid et al. *Proc. Natl. Acad. Sci. USA* 84: 6434-37 (1987)). Sequence conservation can be high especially in the alpha-helical regions of the protein. Growth hormone polypeptides are typically about 200 amino acids. Mature human growth hormones typically contain 191-222 amino acids, with a molecular mass of 22 kDa, after removal of a 26 amino acid peptide signal. Generally, GH is produced as a larger polypeptide (i.e., a precursor polypeptide) that is matured to a smaller polypeptide upon cleavage of the signal sequence; mature GH is about 191-222 amino acids. Hence growth hormones are heterogeneous and occurs in forms that are, for example, 180, 191, 202, 216, 217 and 222 amino acids in length. Examples of growth hormone polypeptides include, but are not limited to, proteins having amino acid sequences set forth in SEQ ID NOS: 1, and 712-715. In one embodiment, the growth hormone polypeptide has a length of 191, 192, 193, 194, 195, 196, 197, 198, 199, 200, 201, 202, 203, 204, 205, 206, 207, 208, 209, 210, 211, 212, 213, 214, 215, 216, 217, 218, 219, 220, 221, or 222 amino acids. In humans, the genes for pituitary (hGH-N) and placental (hGH-V) growth hormones encode 217 amino acid polypeptides. There also are additional isoforms of GH that arise, for example, from alternative splicing. There is, for example, a 214 amino acid isoform of pituitary GH. Placental and pituitary isoforms of GH, share sequence similarity throughout the protein. For example, a comparison of mature GH placental isoform (GenBank Accession No. NP_002050.1) and mature GH pituitary isoform (GenBank Accession No. NP_000506.2) protein sequences shows 13 amino acid differences between the mature GH protein sequences. The variants provided herein can be of any length as long as the desired activity is retained. While variants of a particular length, such as 191, are exemplified, the same variants also can be 192-222 or longer or shorter, and are provided herein.

2. Interaction with Growth Hormone Receptors

The interface between growth hormone and its receptor can be characterized using the resolution of the crystallographic structure of the GH/receptor complex and mutagenesis studies. The complex is formed of one ligand molecule (GH) and two receptor molecules. Consequently, there are two interaction sites with the receptor on the GH molecule. The apparent dissociation constant of the complex is in the range of nanomolar (Kd~0.3 nM) but the two sites do not interact with the same affinity. One site of interaction (referred to as site 1) is of high affinity, and the other site (referred to as site 2) is of low affinity. This distinction in affinity is reflected in the different interfacial surface areas (1300 Å$^2$ for site 1 and 850 Å$^2$ for site 2)

Only a few residues of GH, located at the interface, appear to be essential for the binding to the receptor. These residues are mainly hydrophobic residues. Mutation of the hydrophobic residues to alanine has no effect on the association constant ($k_{on}$) of the complex hormone/receptor, but augments its dissociation constant ($k_{off}$). Thus, these mutations lead to a lower affinity by accelerating the complex dissociation. These mutagenesis results indicate that the hormone binds to the receptor by a simple phenomenon of fast collision and that the role of the hydrophobic residue side chains at the binding sites is to keep the hormone bound once it has reached the receptor. Particular polar residues, charged and uncharged residues, also are important for the binding of GH to its receptor. These polar residues maintain the correct packing of hydrophobic residues of hGH and receptor at the binding sites.

3. Growth Hormone as a Biopharmaceutical

Growth hormone is administered as a therapeutic agent. For example, in humans, GH is used as a therapeutic for treatment of children and adult growth deficiency, Turner syndrome and AIDS wasting among other disorders. Treatment with GH is a well-established therapy. Subjects receiving GH are subject to very frequent repeat applications of the drug, often on a daily basis. For example, GH replacement is normally given by daily subcutaneous (s.c.) injections (see, for example Albertsson-Wikland et al. *Acta. Paediatr. Scand.* 75: 89-97 (1986)). The necessity of frequent and repeated applications of GH is due to its instability in the blood stream and under storage conditions.

Hence, improved GH stability (half-life) in serum and in vitro (e.g., during production, purification and storage conditions) would improve its utility and efficiency as a drug. Accordingly, provided herein are mutant variants of the GH protein that display improved stability as assessed by resistance to proteases and/or increased thermal tolerance, thereby possessing increased protein half-life. The mutant variants that display improved stability possess increased stability in the bloodstream and/or under storage conditions.

C. Exemplary Methods for Modifying Growth Hormone

Provided herein are modified growth hormone proteins. The modified growth hormones (also referred to herein as variants) are increased in stability compared to unmodified growth hormone. Increasing stability (for example, the half-life of proteins in vivo) can result in a decrease in the frequency of injections needed to maintain a sufficient drug level in serum, thus leading to i) higher comfort to and acceptance by treated subjects, particularly human subjects, ii) lower doses necessary to achieve comparable biological effects, and iii) as a consequence, an attenuation of the (dose-dependent) secondary effects.

Increased stability of GH can be achieved, for example, by destruction of protease target residues or sequences and/or (ii) by an increase in thermal tolerance of the protein. Modification of GH to increase stability can be accomplished while keeping an activity unchanged compared to the unmodified or wild-type GH. Any methods known in the art can be used to create modified growth hormone proteins. In the methods described herein, modifications are chosen using the method of 2D-scanning mutagenesis (see for example, WO 2004/022747 and WO 2004/022593).

Proteases, proteinases or peptidases catalyze the hydrolysis of covalent peptidic bonds. Serine proteases participate in a range of functions in the body, including blood clotting, inflammation as well as digestive enzymes in both prokaryotes and eukaryotes. Serine proteases are sequence specific. While cascades of protease activations control blood clotting and complement, other proteases are involved in signaling pathways, enzyme activation and degradative functions in different cellular or extracellular compartments.

Serine proteases include, but are not limited, to chymotrypsin, trypsin, elastase, matrix metalloproteinases, such as gelatinase B and gelatinase A, NS3, elastase, factor Xa, Granzyme B, thrombin, trypsin, plasmin, urokinase, tPA and PSA. Chymotrypsin, trypsin and elastase are synthesized by the pancreatic acinar cells, secreted in the small intestine and are responsible for catalyzing the hydrolysis of peptide bonds. All three of these enzymes are similar in structure, as shown through their X-ray structures. Each of these digestive serine proteases targets different regions of the polypeptide chain, based upon the amino acid residues and side chains surrounding the site of cleavage. The active site of serine proteases is shaped as a cleft where the polypeptide substrate binds. Amino acid residues are labeled from N to C term of the polypeptide substrate (Pi, . . . , P3, P2, P1, P1', P2', P3', . . . , Pj) and their respective binding sub-sites (Si, . . . , S3, S2, S1, S1', S2', S3', . . . , Sj). The cleavage is catalyzed between P1 and P1'. Chymotrypsin is responsible for cleaving peptide bonds flanked with bulky hydrophobic amino acid residues. Particular residues include phenylalanine, tryptophan and tyrosine, which fit into a snug hydrophobic pocket. Trypsin is responsible for cleaving peptide bonds flanked with positively charged amino acid residues. Instead of having the hydrophobic pocket of the chymotrypsin, there exists an aspartic acid residue at the back of the pocket. This can then interact with positively charged residues such as arginine and lysine. Elastase is responsible for cleaving peptide bonds flanked with small neutral amino acid residues, such as alanine, glycine and valine. The pocket that is in trypsin and chymotrypsin is now lined with valine and threonine, rendering it a mere depression, which can accommodate these smaller amino acid residues.

Serine proteases are ubiquitous in prokaryotes and eukaryotes and serve important and diverse biological functions such as hemostasis, fibrinolysis, complement formation and the digestion of dietary proteins. Among the serine proteases are matrix metalloproteinases, such as gelatinase B (matrix metalloproteinase 9 (MM9)) and gelatinase A. Proteases to which resistance is increased, include those that occur, for example, in body fluids and tissues, such as those that include, but are not limited to, saliva, blood, serum, intestinal, stomach, blood, cell lysates, cells and others. These include proteases of all types.

In principle, there are several general approaches described for protein directed evolution based on mutagenesis. Any of these, alone or in combination can be used to modify a polypeptide such as GH to achieve increased conformational stability and/or resistance to proteolysis. Such methods include random mutagenesis, where the amino acids in the starting protein sequence are replaced by all (or a group) of the 20 amino acids either in single or multiple replacements at different amino acid positions are generated on the same molecule, at the same time. Another method, restricted random mutagenesis, introduces either all of the 20 amino acids or DNA-biased residues. The bias is based on the sequence of the DNA and not on that of the protein, in a stochastic or semi-stochastic manner, respectively, within restricted or predefined regions of the protein, known in advance to be involved in the activity "evolved." Additionally, methods of rational mutagenesis including 1D-scanning, 2D-scanning and 3D-scanning can be used alone or in combination to construct modified hGH variants.

1. 1D Scanning ("Rational Mutagenesis")

Rational mutagenesis, also termed 1D-scanning, is a two-step process and is described in co-pending U.S. application Ser. No. 10/022,249 (U.S. application Publication No 2003-0134351-A1). Briefly, in the first step, full-length amino acid scanning is performed where each and every of the amino acids in the starting protein sequence, such as hGH (SEQ ID NO:1) is replaced by a designated reference amino acid (e.g., alanine). Only a single amino acid is replaced on each protein molecule at a time. These amino acid positions are referred to as HITs. In the second step, a new collection of molecules is generated such that each molecule differs from each of the others by the amino acid present at the individual HIT positions identified in step 1. All 20 amino acids (19 remaining) are introduced at each of the HIT positions identified in step 1; while each individual molecule contains, in principle, one and only one amino acid replacement. The newly generated mutants that lead to a desired alteration (such as an improvement) in a protein activity are referred to as LEADs. The methods permit, among other things, identification of new unpredicted sequences of amino acids at unpredicted regions along a protein to produce a protein that exhibits a desired altered activity compared to the starting protein. Further, because the selection of the target region (HITs and surrounding amino acids) for the second step is based upon experimental data on activity obtained in the first step no prior knowledge of protein structure and/or function is necessary.

2. 3D Scanning 3D-scanning, as described in co-pending U.S. Published Application No. 2004-0132977-A1 and U.S. application Ser. No. 10/685,355 and published PCT applications WO 2004/022747 and WO 2004/022593, is an additional method of rational evolution of proteins based on the identification of potential target sites for mutagenesis (is-HITs). The method uses comparison of patterns of protein backbone folding between structurally related proteins, irrespective of the underlying sequences of the compared proteins. Once the structurally related amino acid positions are identified on the protein of interest, then suitable amino acid replacement criteria, such as PAM analysis, can be employed to identify candidate LEADs for construction and screening.

3. 2D-Scanning (Restricted Rational Mutagenesis)

The 2D-scanning (or restricted rational mutagenesis) methods for protein rational evolution (see, co-pending U.S. application Ser. Nos. 10/685,355 and U.S. Published Application No. US-2004-0132977-A1 and published International applications WO2004022593 and WO2004022747) are based on scanning over two dimensions. The first dimension is the amino acid position along the protein sequence, in order to identify is-HIT target positions. The second dimension is scanning the amino acid type selected for replacing a particular is-HIT amino acid position. An advantage of the 2D-scanning methods provided herein is that at least one, and typically the amino acid position and/or the replacing amino acid can be restricted such that fewer than all amino acids on the protein-backbone are selected for amino acid replacement; and/or fewer than all of the remaining 19 amino acids available to replace an original, such as native, amino acid are selected for replacement.

Based on i) the particular protein properties to be evolved (i.e., resistance to proteolysis), ii) sequence of amino acids of the protein, and iii) the known properties of the individual amino acids, a number of target positions along the protein sequence are selected, in silico, as "is-HIT target positions." This number of is-HIT target positions is as large as reasonably possible such that all reasonably possible target positions for the particular feature being evolved are included. In particular, embodiments where a restricted number of is-HIT target positions are selected for replacement, the amino acids selected to replace the is-HIT target positions on the particular protein being optimized can be either all of the remaining 19 amino acids or, more frequently, a more restricted group containing selected amino acids that are contemplated to have the desired effect on protein activity. In another embodiment, so long as a restricted number of replacing amino acids are used, all of the amino acid positions along the protein backbone can be selected as is-HIT target positions for amino acid replacement. Mutagenesis then is performed by the replacement of single amino acid residues at specific is-HIT target positions on the protein backbone (e.g., "one-by-one," such as in addressable arrays), such that each individual mutant generated is the single product of each single mutagenesis reaction. Mutant DNA molecules are designed, generated by mutagenesis and cloned individually, such as in addressable arrays, such that they are physically separated from each other and that each one is the single product of an independent mutagenesis reaction. Mutant protein molecules derived from the collection of mutant DNA molecules also are physically separated from each other, such as by formatting in addressable arrays. Thus, a plurality of mutant protein molecules is produced. Each mutant protein contains a single amino acid replacement at only one of the is-HIT target positions. Activity assessment is then individually performed on each individual protein mutant molecule, following protein expression and measurement of the appropriate activity. An example of practice of this method is shown in the Examples in which mutant hGH molecules are produced.

The newly generated proteins that lead to altered, typically improved, target protein activity are referred to as LEADs. This method relies on an indirect search for protein improvement for a particular activity (such as increased resistance to proteolysis), based on amino acid replacement and sequence change at single or, in another embodiment, a limited number of amino acid positions at a time. As a result, optimized proteins, which have modified sequences of amino acids at some regions along the protein that perform better (at a particular target activity or other property) than or different from the starting protein, are identified and isolated.

2D-scanning on GH was used to generate variants improved in protein stability, including improved resistance to proteolysis and improved thermal tolerance. To effect such modifications, amino acid positions were selected using in silico analysis of hGH.

a. Identifying In-silico HITs

The 2D-scanning method for directed evolution of proteins includes identifying and selecting (using in silico analysis) specific amino acids and amino acid positions (referred to herein as is-HITs) along the protein sequence that are contemplated to be directly or indirectly involved in the feature being evolved. As noted, the 2D-scanning methods provided include the following two steps. The first step is an in silico search of a target sequence of amino acids of the protein to identify all possible amino acid positions that potentially can be targets for the activity being evolved. This is effected, for example, by assessing the effect of amino acid residues on the property(ies) to be altered on the protein, using any known standard software. The particulars of the in silico analysis is a function of the property to be modified.

Once identified, these amino acid positions or target sequences are referred to as "is-HITs" (in silico HITs). In silico HITs are defined as those amino acid positions (or target positions) that potentially are involved in the "evolving" feature, such as increased resistance to proteolysis or thermal tolerance. The discrimination of the is-HITs among all the amino acid positions in a protein sequence can be made based on the amino acid type at each position in addition to the information on the protein secondary or tertiary structure. In silico HITs constitute a collection of mutant molecules such that all possible amino acids, amino acid positions or target sequences potentially involved in the evolving feature are represented. No strong theoretical discrimination among amino acids or amino acid positions is made at this stage. In silico HIT positions are spread over the full length of the protein sequence. Single or a limited number of is-HIT amino acids are replaced at a time on the target hGH protein.

A variety of parameters can be analyzed to determine whether or not a particular amino acid on a protein might be involved in the evolving feature, typically a limited number of initial premises (typically no more than 2) are used to determine the in silico HITs. For example, as described herein, to increase the thermal tolerance of hGH, the first condition is the nature of the amino acids linked to thermal tolerance of the molecule such as its potential participation in chemical bridges that can participate in stabilization of the molecule. The second premise is typically related to the specific position of those amino acids along the protein structure.

During the first step of identification of is-HITs according to the methods provided herein, each individual amino acid along the protein sequence is considered individually to assess whether it is a candidate for is-HIT. This search is done one-by-one and the decision on whether the amino acid is considered to be a candidate for a is-HIT is based on (1) the amino acid type; (2) the position in the protein and protein structure if known; and (3) the predicted interaction between that amino acid and its neighbors in sequence and space.

Is-HITs were identified for a number of properties of hGH that contribute to protein stability. These properties included 1) increasing saline (polar) interactions between helices; 2) increasing H-bond interactions between helices and 3) removal of protease sensitive sites.

b. Identifying Replacing Amino Acids

Once the is-HITs target positions are selected, the next step is identifying those amino acids that will replace the original, such as native, amino acid at each is-HIT position to alter the activity level for the particular feature being evolved. The set of replacing amino acids to be used to replace the original, such as native, amino acid at each is-HIT position can be different and specific for the particular is-HIT position. The choice of the replacing amino acids takes into account the need to preserve the physicochemical properties such as hydrophobicity, charge and polarity of essential (e.g., catalytic, binding, etc.) residues and alter some other property of the protein (i.e., protein stability). The number of replacing amino acids of the remaining 19 non-native (or non-original) amino acids that can be used to replace a particular is-HIT target position ranges from 1 up to about 19 and anywhere in between depending on the properties for the particular modification.

Numerous methods of selecting replacing amino acids (also referred to herein as "replacement amino acids") are well known in the art. Protein chemists determined that certain amino acid substitutions commonly occur in related proteins from different species. As the protein still functions with these substitutions, the substituted amino acids are compatible with protein structure and function. Often, these substitutions are to a chemically similar amino acid, but other types of changes, although relatively rare, also can occur.

Knowing the types of changes that are most and least common in a large number of proteins can assist with predicting alignments and amino acid substitutions for any set of protein sequences. Amino acid substitution matrices are used for this purpose. A number of matrices are available. A detailed presentation of such matrices can be found in the co-pending U.S. application Ser. No. 10/685,355 and U.S. Published Application No. US-2004-0132977-A1 and published International applications WO 2004/022593 and WO 2004/022747, which are incorporated herein in their entirety (where permitted). Such matrices also are known and available in the art, for example in the reference listed below.

In amino acid substitution matrices, amino acids are listed horizontally and vertically, and each matrix position is filled with a score that reflects how often one amino acid would have been paired with the other in an alignment of related protein sequences. The probability of changing amino acid "A" into amino acid "B" is assumed to be identical to the reverse probability of changing "B" into "A." This assumption is made because, for any two sequences, the ancestor amino acid in the phylogenetic tree is usually not known. Additionally, the likelihood of replacement should depend on the product of the frequency of occurrence of the two amino acids and on their chemical and physical similarities. A prediction of this model is that amino acid frequencies will not change over evolutionary time (Dayhoff et al., *Atlas of Protein Sequence and Structure*, 5(3): 345-352, (1978)). Several exemplary amino acid substitution matrices, including, but not limited to, block substitution matrix (BLOSUM) (Henikoff et al., *Proc. Natl. Acad. Sci. USA*, 89: 10915-10919 (1992)), Jones (Jones et al., *Comput. Appl. Biosci.*, 8: 275-282 (1992)), Gonnet (Gonnet et al., *Science*, 256: 1433-1445 (1992)), Fitch (*J. Mol. Evol.*, 16(1): 9-16 (1966)), Feng (Feng et al., *J. Mol. Evol.*, 21: 112-125, (1985)), McLachlan (*J. Mol. Biol.*, 61: 409-424 (1971)), Grantham (*Science*, 185: 862-864 (1974)), Miyata (*J. Mol. Evol.*, 12: 219-236 (1979)), Rao (*J. Pept. Protein Res.*, 29: 276-281 (1987)), Risler (*J. Mol. Biol.*, 204: 1019-1029 (1988)), Johnson (Johnson et al., *J. Mol. Biol.*, 233: 716-738 (1993)), and Point Accepted Mutation (PAM) (Dayhoff et al. *Atlas Protein Seq. Struct.* 5: 345-352 (1978)).

The outcome of the two steps set forth above, which is performed in silico is that: (1) the amino acid positions that are the target for mutagenesis are identified (referred to as is-HITs); and (2) the replacing amino acids for the original, such as native, amino acids at the is-HITs are identified, to provide a collection of candidate LEAD mutant molecules that are expected to perform differently from the native molecule. These are assayed for a desired optimized (or improved or altered) activity.

C. Construction of Modified Polypeptides and Biological Assays

Once is-HITs are selected as set forth above, replacing amino acids are introduced. Mutant proteins typically are prepared using recombinant DNA methods and assessed in appropriate biological assays for the particular activity (feature) optimized. An exemplary method of preparing the mutant proteins is by mutagenesis of the original, such as native, gene using methods well known in the art. Mutant molecules are generated one-by-one, such as in addressable arrays, such that each individual mutant generated is the single product of each single and independent mutagenesis reaction. Individual mutagenesis reactions are conducted separately, such as in addressable arrays where they are physically separated from each other. Once a population of sets of nucleic acid molecules encoding the respective mutant proteins is prepared, each is separately introduced one-by-one into appropriate cells for the production of the corresponding mutant proteins. This also can be performed, for example, in addressable arrays where each set of nucleic acid molecules encoding a respective mutant protein is introduced into cells confined to a discrete location, such as in a well of a multi-well microtiter plate. Each individual mutant protein is individually phenotypically characterized and performance is quantitatively assessed using assays appropriate for the feature being optimized (i.e., feature being evolved). Again, this step can be performed in addressable arrays. Those mutants displaying a desired increased or decreased performance compared to the original, such as native molecules are identified and designated LEADs. From the beginning of the process of generating the mutant DNA molecules up through the readout and analysis of the performance results, each candidate LEAD mutant is generated, produced and analyzed individually, such as from its own address in an addressable array. The process is amenable to automation.

D. Modified Growth Hormone Polypeptides

Provided herein is a method of increasing stability and half-life of a polypeptide by increasing resistance to proteolysis and/or by increasing thermal tolerance. Provided herein are methods of modifying polypeptides, such as growth hormone, to increase resistance to proteolysis by proteases (blood, serum, gastrointestinal, etc.), whereby the modified polypeptide exhibits increased half-life in vitro and/or in vivo. Provided herein are methods of contacting proteolytic enzymes with peptide inhibitors, thereby inhibiting an activity of the proteases (blood, serum, gastrointestinal, etc.). As a result of the contacting, the polypeptide susceptible to proteolysis exhibits increased half-life in vitro or in vivo. Provided herein are methods of modifying polypeptides to increase resistance to proteolysis by proteases and contacting proteolytic enzymes with peptide inhibitors, thereby inhibiting an activity of the proteases. Also provided herein are the modified polypeptides generated by such methods. Provided herein are modified growth hormone polypeptides that display improved stability as assessed by resistance to proteases and/or increased thermal tolerance; the modified polypeptides exhibiting these properties possess, thereby, increased protein half-life in vitro or in vivo.

Provided herein are modified GH polypeptides that display improved stability as assessed by resistance to proteases and/or increased thermal tolerance; the modified polypeptides exhibiting these properties possess, thereby, increased protein half-life in vitro or in vivo.

Provided herein are modified (variant, mutant, etc.) GH (also referred to herein as modified GH polypeptides) that display improved stability as assessed by resistance to proteases and/or increased thermal tolerance. Such modified GH polypeptides can have an increased protein half-life in vitro (e.g., during production, purification and storage) and in vivo. In one embodiment, the modified GH polypeptides provided herein confer at least comparable activity. For example, the modified GH polypeptides confer at least comparable activity as assessed by GH-specific cell proliferation activity compared to the unmodified and/or wild type native GH polypeptide.

Modified GH polypeptides provided herein include human GH variants. Modified GH polypeptides provided herein have been modified compared to the amino acid sequence set forth in SEQ ID NO: 1. The hGH polypeptide can be of any human tissue or cell-type origin. Human GH polypeptides include polypeptide sequences such as set forth in SEQ ID NOS: 1, 712 and 713. Modified GH polypeptides provided herein also include variants of GH of non-human origin. For example, modified GH polypeptides can be variants of a mammalian GH including, bovine, rat, rabbit, sheep, primate, horse, porcine, monkey, baboon, gibbon, macaque, gorilla, orangutan and chimpanzee GH. Modified GH polypeptides also include polypeptides that are hybrids of different GH sequences and also synthetic GH sequences constructed from GH sequences known in the art.

The modified GH polypeptides provided herein alter specific structural features of the cytokine that contribute to GH stability. The modified GH polypeptides provided herein include variants that possess increased resistance to proteolysis and/or increased thermal tolerance. Hence, the modified GH polypeptides provided herein offer GHs with advantages including a decrease in the frequency of injections needed to maintain a sufficient drug level in serum, thus leading to, for example, higher comfort and acceptance by subjects, lower doses necessary to achieve comparable biological effects and attenuation of secondary effects.

Structural modifications can be made in GH by amino acid replacements to increase the conformational stability of GH. Such modifications include those that increase the conformational stability of GH while either improving or maintaining the requisite activity (e.g., cell proliferation activity). These modifications can result in GH variants with improved stability as assessed by resistance to proteases and/or increased thermal tolerance. Such modified GH polypeptides exhibit increased in protein half-life compared to native GH in vitro and/or in vivo. These modifications include destruction of target sequences of amino acids sensitive to proteolysis, modification of hydrophobic patches to increase polar interactions with solvent and increasing polar interactions between particular helices of GH.

Structural modifications in GH include combining one, two or more amino acid replacements at different positions within the GH sequence to increase the stability of the entire GH. Such combinations can be used to improve stability as assessed by resistance to proteases and/or increased thermal tolerance. For example, two or more modifications in one or more categories can be combined, where the categories are selected from, for example, disruption of target sequences sensitive to proteolysis, modification of hydrophobic patches to increase polar interactions with solvent, increasing polar interactions between helices and increasing interactions between helices. In addition, one or more modifications in such categories can be combined with one or more modifications of any known type to increase GH stability, for example, modifications which remove protease sensitive sites in GH with modifications of any known type that increase thermal tolerance.

Also among the variants provided herein are modified GH polypeptides with two or more modifications compared to native or wild-type GH. In one example, the hGH is a modified pituitary hGH. Modified GH polypeptides include those with 2, 3, 4, 5, 6, 7, 8, 9, 10, 11, 12, or more modified positions. The two or more modifications can include two or more modifications of the same property, e.g., two modifications that modify hGH thermal tolerance or two modifications that modify resistance to proteases. In another embodiment, the two or more modifications include combinations of properties that each contribute to GH stability. For example, a modified GH polypeptide can include one or more modifications that alters GH thermal tolerance and one or more modifications that remove a protease sensitive site. In one embodiment are modified growth hormone polypeptides having one or more amino acid replacements in the sequence of amino acids of the mature growth hormone where if position 9 is replaced, the replacing amino acid is not proline; if position 13 is replaced, the replacing amino acid is not valine; if position 14 is replaced, the replacing amino acid is not serine; if position 54 is replaced, the replacing amino acid is not proline; if position 56 is replaced, the replacing amino acid is not aspartate; if position 64 is replaced, the replacing amino acid is not methionine; if position 65 is replaced, the replacing amino acid is not valine or alanine; if position 66 is replaced, the replacing amino acid is not glutamine or lysine; if position 92 is replaced, the replacing amino acid is not leucine; if position 120 is replaced, the replacing amino acid is not arginine; if position 126 is replaced, the replacing amino acid is not arginine; if position 129 is replaced, the replacing amino acid is not threonine; if position 133 is replaced, the replacing amino acid is not histidine or arginine; if position 134 is replaced, the replacing amino acid is not leucine; and if position 140 is replaced, the replacing amino acid is not asparagine. GH variants carrying replacements at more than one is-HIT sites, and that display improved stability, are called super-LEADs. A GH super-LEAD can for example, contain 2, 3, 4, 5, 6, 7, 8, 9, 10 or more than 10 amino acid changes compared to wild-type or unmodified GH.

Provided herein are any of the modified growth hormones described above wherein the number of positions replaced is 2, 3, 4, 5, 6, 7, 8, 9, 10, 11, 12, 13, 14, 15, 16, 17, 18, 19, or 20 compared to unmodified growth hormone. In one embodiment, the modified growth hormones provided herein include amino acid replacement(s) at one or more of the following positions: 56, 59, 64, 65, 66, 88, 92, 94, 101, 129, 130, 133, 134, 140, 143, 145, 146, 147, 183, and 186 of mature human growth hormone having the sequence of amino acids set forth in SEQ ID NO:1. In one embodiment, the positions include E56, P59, R64, E65, E66, E88, F92, R94, L101, E129, D130, P133, R134, K140, Y143, K145, F146, D147, R183 and E186. In one embodiment, positions are replaced as follows: replacing E with any of Q, N and H, replacing P with S or A, replacing R with H or Q, replacing L or F with I or V, replacing K or D with Q or N, and replacing Y with H or I. For example, such replacements include E56Q, E56N, E56H, P59S, P59A, R64H, R64Q, E65Q, E65N, E65H, E66Q, E66N, E66H, E88Q, E88N, E88H, F92I, F92V, R94H, R94Q, L101V, L101I, E129Q, E129N, E129H, D130Q, D130N, P133S, P133A, R134H, R134Q, K140Q, K140N, Y143H, Y143I, K145Q, K145N, F146I, F146V, D147Q, D147N, R183H, R183Q, E186Q, E186N and E186H.

1. Increased Resistance to Proteolysis by Removal of Proteolytic Sites

Among modifications of interest for therapeutic proteins such as GH are those that increase conformational stability. Increasing conformational stability can be accomplished by increasing the resistance of the protein to proteolysis. Such stability increase can include increasing protease resistance (and hence protein half-life) while maintaining the requisite activity. Such changes are useful for producing longer-lasting therapeutic proteins.

a. Properties of Growth Hormone Polypeptides Modified by Removal of Proteolytic Sites Provided herein are modifications of GH polypeptides that have increased in vitro or in vivo stability by increasing the resistance of the modified GH to proteolysis. Among the modified GH polypeptides provided herein are GH variants modified to: 1) increase saline (polar) interactions between helices; 2) increase H-bond interactions between helices and 3) remove protease sensitive sites.

In one example, the modified GH polypeptides that are increased in stability are human GH polypeptides. The 2D-scanning methodology was used to identify the amino acid changes on hGH that lead to an increase in stability when challenged either with proteases (blood, serum, intestinal, etc.), blood lysate or serum. Increasing protein stability to proteases, blood lysate or serum is contemplated herein to provide a longer in vivo half-life for the particular protein molecules, and thus a reduction in the frequency of necessary injections into subjects. In one example, an activity of modified hGH is assessed in an assay by measuring the capacity of the modified GH to stimulate cell proliferation when added to the appropriate cells. Prior to the measurement of activity, hGH molecules can be exposed to blood, serum, or intestinal proteases (in vitro assays), or serum/intestinal (in vivo assays in mice) during different incubation or post-injection times. The activity measured corresponds to the residual activity following exposure to the proteolytic mixtures An activity of the modified GH can be compared to an unmodified GH as a measurement of the effect of the modification on protease stability and activity. In one example, the unmodified GH is a wild-type, native GH. In another example, the unmodified GH is a variant form of GH that was used as a starting material to introduce further modifications. Modified GH also can be compared with any known GH polypeptides in such assays to compare protease sensitivity and/or other activity. Additionally, any assays known in the art to assess protein stability, protease resistance and sensitivity and GH activity can be used to assess the modified GH polypeptides herein.

Provided herein are GH molecules that maintain a requisite activity without substantial change and have been rendered less susceptible to digestion by blood, serum or intestinal proteases and therefore display a longer half-life in circulation. Such GH molecules include modified GH polypeptides with an activity sufficient for therapeutic application(s).

Provided herein are modified GH polypeptides with increased protease resistance. In exemplary embodiments, the half-life in vitro or in vivo (serum stability) of the GH mutants provided herein is increased by an amount selected from at least 10%, at least 20%, at least 30%, at least 40%, at least 50%, at least 60%, at least 70%, at least 80%, at least 90%, at least 100%, at least 150%, at least 200%, at least 250%, at least 300%, at least 350%, at least 400%, at least 450%, at least 500% or more, when compared to the half-life of native GH in either human blood, human serum or an in vitro mixture containing one or more proteases. In other embodiments, the half-life in vitro or in vivo (serum stability) of the GH mutants provided herein is increased by an amount selected from at least 6 times, 7 times, 8 times, 9 times, 10 times, 20 times, 30 times, 40 times, 50 times, 60 times, 70 times, 80 times, 90 times, 100 times, 200 times, 300 times, 400 times, 500 times, 600 times, 700 times, 800 times, 900 times, 1000 times, or more, when compared to the half-life of native GH in either human blood, human serum or an in vitro mixture containing one or more proteases. In an exemplary embodiment, such GH variants are generated by modifying the human GH polypeptide. In one such exemplary embodiment, GH variants are generated by modifying the human pituitary GH polypeptide b. Generation of Growth Hormone Polypeptides Modified by Removal of Proteolytic Sites In an example of generating variants increased in stability by removal of proteolysis sites, pituitary hGH was modified. The first step in the design of hGH mutants resistant to proteolysis includes identifying sites vulnerable to proteolysis along the protein sequence. Based on a list of selected proteases considered (Table 2) as well as other blood, serum and intestinal proteases described herein, the complete list of all amino acids and sequences of amino acids in hGH that can be targeted by those proteases was first determined in silico. The protease targets (amino acids or sequences of amino acids along the hGH sequence) are named in silico HITs (is-HITs). Since protease mixtures in the body are quite complex in composition it can be expected that the majority of the residues in a given protein sequence can be targeted for proteolysis.

The second step in the design of hGH mutants which are resistant to proteolysis includes identifying the appropriate replacing amino acids such that if they replaced the natural amino acids in hGH at is-HITs, the protein would (i) become resistant to proteolysis and (ii) elicit a level of an activity comparable to the wild-type hGH protein. The choice of the replacing amino acids must consider the broad target specificity of certain proteases and the need to preserve the physicochemical properties such as hydrophobicity, charge and polarity of essential (e.g., catalytic, binding, etc.) residues in GH.

As a part of the 2D-scanning approach, the so-called "Point Accepted Mutation" (PAM; Dayhoff et al., 1978 (FIG. 2). PAM values, originally developed to produce alignments between protein sequences, are available in the form of probability matrices, which reflect an evolutionary distance between amino acids. "Conservative substitutions" of a residue in a reference sequence are those substitutions that are physically and functionally similar to the corresponding reference residues, e.g., that have a similar size, shape, electric charge, chemical properties, including the ability to form covalent or hydrogen bonds and other such interactions. Conservative substitutions show the highest scores fitting with the PAM matrix criteria in the form of "accepted point mutations." The PAM250 matrix is used in the frame of 2D-scanning to identify candidate replacing amino acids for the is-HITs in order to generate conservative mutations without affecting protein function. At least the two amino acids with the highest values in PAM250 matrix, corresponding to "conservative substitutions" or "accepted point mutations," were chosen for replacement at each is-HIT. The replacement of amino acids by cysteine residues is explicitly avoided since this change would potentially lead to the formation of intermolecular disulfide bonds.

Briefly, using the algorithm PROTEOL (on line at infobiogen.fr and at bioinfo.hku.hk/services/analyseq/cgi-bin/proteol_in.pl), a list of residues along the hGH protein of 191 amino acids (SEQ ID NO:1), which can be recognized as substrate for proteases in Table 2 was established (FIG. 1). The algorithm generates a proteolytic digestion map based on a list of proteases, their proteolytic specificity and the polypeptide amino acid sequence that is entered.

TABLE 2

| Abbreviation | Amino Acid Position | Protease or chemical Treatment |
| --- | --- | --- |
| AspN | D | Endoproteinase Asp-N |
| Chymo | (F, W, Y, M, L)~P | Chymotrypsin |
| Clos | R | Clostripain |
| CnBr | M | Cyanogen Bromide |
| IBzO | W | IodosoBenzoate |
| Myxo | K | Myxobacter |
| NH$_2$OH | N G | Hydroxylamine |
| pH2.5 | D P | pH 2.5 |
| ProEn | P | Proline Endopeptidase |
| Staph | E | Staphylococcal Protease |
| Tryp | (K, R)~P | Trypsin |
| TrypK | K~P | Trypsin(Arg blocked) |
| TrypR | R~P | Trypsin(Lys blocked) |

Table 2 shows the in silico identification of some amino acid positions that are targets for proteolysis using a number of selected proteases and chemical treatment.

Is-HITS were identified and LEADS created for higher resistance to proteolysis of hGH. The native amino acids at each of the is-HIT positions and replacing amino acids for increased resistance to proteolysis can include, but are not limited to R with H and/or Q; E with H, Q and/or N; K with Q and/or N; D with N and/or Q; M with I and/or V; P with A and/or S; Y with I and/or H; F with I and/or V; W with H and/or S; L with I and/or V (See Table 3). Is-HITS and LEADs can include modifications at particular regions susceptible to proteolysis.

In one embodiment, the regions selected for modification include one or more amino acid modifications in a region corresponding to positions in mature human growth hormone selected from among amino acid 1 to 12, 14 to 26, 29 to 53, 57, 58, 60 to 63, 67 to 78, 80 to 84, 86, 87, 89, 91, 93, 95 to 100, 102 to 113, 115 to 128, 131, 132, 135 to 139, 141, 142, 144, 148 to 160, 162 to 182, 185 and 187 to 191 of SEQ ID NO: 1. In another embodiment, the positions modified correspond to one or more, e.g., 2, 3, 4, 5, 6, 7, 8, 9, 10, 11, 12, 13, 14, 15, 16, 17, 18, 19, 20 or more positions. In one embodiment, a GH is modified to include one or more single amino acid replacements compared with the unmodified growth hormone, where the replacement positions are not positions that correspond to positions 13, 27, 28, 54-56, 59, 64 to 66, 79, 85, 88, 90, 92, 94, 101, 114, 129, 130, 133, 134, 140, 143, 145 to 147, 161, 183, 184 and 186 of SEQ ID NO:1.

For example, pituitary hGH is modified to include one or more amino acid modifications in amino acid positions corresponding to selected from among amino acid positions 1 to 12, 14 to 26, 29 to 53, 57, 58, 60 to 63, 67 to 78, 80 to 84, 86, 87, 89, 91, 93, 95 to 100, 102 to 113, 115 to 128, 131, 132, 135 to 139, 141, 142, 144, 148 to 160, 162 to 182, 185 and 187 to 191 of mature human growth hormone set forth as SEQ ID NO:1. In another embodiment, a placental hGH is modified at such corresponding positions. Placental hGH is aligned with pituitary hGH, one or more amino acid positions are selected that correspond to positions of pituitary hGH, for example SEQ ID NO:1. In another embodiment, a GH of non-human origin, e.g., bovine, sheep or monkey GH, is modified. Such alignments and selection of positions can be performed with any GH polypeptide by aligning it with pituitary hGH and selecting corresponding positions for modification.

In one embodiment, positions corresponding to pituitary hGH are selected (is-HITS) and amino acid replacements are made (LEADs) with increased resistance to proteolysis. Positions include, but are not limited to, F1I/P2A, F1I/P2S, F1V/P2A, F1V/P2S, P5A, P5S, L6I, L6V, R8H, R8Q, L9I, L9V, F10I, F10V, D11N, D11Q, M14I, M14V, L15I, L15V, R16H, R16Q, R19H, R19Q, L20I, L20V, L23I, L23V, F25I, F25V, D26N, D26Q, Y28H, Y28I, E30Q, E30H, E30N, F31I, F31V, E32Q, E32H, E32N, E33Q, E33H, E33N, Y35H, Y35I, P37A, P37S, K38N, K38Q, E39Q, E39H, E39N, K41N, K41Q, Y42H, Y42I, F44I, F44V, L45I, L45V, P48A, P48S, L52I, L52V, F54I, F54V, E56Q, E56H, E56N, P59A, P59S, P61A, P61S, R64H, R64Q, E65Q, E65H, E65N, E66Q, E66H, E66N, K70N, K70Q, L73I, L73V, E74Q, E74H, E74N, L75I, L75V, L76I, L76V, R77H, R77Q, L80I, L80V, L81I, L81V, L82I, L82V, W86H, W86S, L87I, L87V, E88Q, E88H, E88N, P89A, P89S, F92I, F92V, L93I, L93V, R94H, R94Q, F97I, F97V, L101I, L101V, Y103H, Y103I, D107N, D107Q, Y111H, Y111I, D112N, D 112Q, L113I, L113V, L114I, L114V, K115N, K115Q, D116N, D116Q, L17I, L117V, E118Q, E118H, E118N, E119Q, E119H, E119N, L124I, L124V, M125I, M125V, R127H, R127Q, L128I, L128V, E129Q, E129H, E129N, D130N, D130Q, P133A, P133S, R134H, R134Q, F139I, F139V, K140N, K140Q, Y143H, Y143I, K145N, K145Q, F146I, F146V, D147N, D147Q, D153N, D153Q, D154N, D154Q, L156I, L156V, L157I, L157V, K158N, K158Q, Y160H, Y160I, L162I, L162V, L163I, L163V, Y164H, Y164I, F166I, F166V, R167H, R167Q, K168N, K168Q, D169N, D169Q, M170I, M170V, D171N, D171Q, K172N, K172Q, E174Q, E174H, E174N, F176I, F176V, L177I, L177V, R178H, R178Q, R183H, R183Q, E186Q, E186H, E186N, F191I, and F191V (see Table 4 and SEQ ID NOS: 2-223). In reference to such mutants, the first amino acid (one-letter abbreviation) corresponds to the amino acid that is replaced, the number corresponds to position in the hGH sequence in reference to SEQ ID NO:1, and the second amino acid (one-letter abbreviation) corresponds to the amino acid selected that replaces the amino acid at that position. The GH employed for modification can be any GH, including other mammalian GHs, and placental GH. Corresponding positions, as assessed by appropriate alignment, are identified and modified.

c. Additional Modified Growth Hormone Polypeptides

In particular embodiments, variant GH molecules also can be generated that contain one or more amino acids at one or more is-HIT sites that have been replaced by candidate LEAD amino acids. Those mutant proteins carrying one or more mutations at one or more is-HITs, and that display improved protease resistance are called LEADs (one mutation at one is-HIT) and super-LEADs (mutations at more than one is-HIT).

In additional embodiments, mutant molecules that display improved protease resistance, LEADs and super-LEADs can be further modified with additional mutations that confer protein stability, such as those described herein. For example, protease-resistant LEADs and super-LEADs can be modified to contain mutations including: 1) increasing saline (polar) interactions between helices; 2) increasing H-bond interactions between helices and 3) other modifications that lead to increased resistance to proteolysis.

d. Assessment of Modified Growth Hormone Polypeptides with Increased Resistance to Proteolysis Increased resistance to proteolysis of modified GH polypeptides can be assessed by any methods known in the art to assess protein stability, protease sensitivity and resistance and/or GH activity. In one example, protease resistance is measured by incubating a modified GH polypeptide with one or more proteases and then assessing residual activity compared to an untreated control. A modified GH polypeptide can be compared to an unmodified and/or wild-type native GH treated under similar conditions to determine if the particular variant retains more activity than the unmodified GH. Activity can be assessed by any methods known in the art, such as, by measuring increased muscle mass, anti-aging and proliferation activities.

Kinetic studies of protease resistance also can be used to assess a modified GH polypeptide. For example, a modified GH polypeptide is incubated with one or more proteases and samples are taken over a series of time-points. At each time point, the proteases are inactivated, and the samples are then tested for GH activity. Modified GH polypeptides can be compared to an untreated control and to similar treatments on unmodified and/or wild-type GH to determine protease resistance of the modified GH polypeptides.

Modified GH polypeptides provided herein exhibit increased resistance to proteolysis by proteases, including those that occur, for example, in body fluids and tissues, such as those that include, but are not limited to, saliva, blood, serum, intestinal, stomach, blood, cell lysates, cells and others. Modifications can include resistance to one or more proteases including, but not limited to, pepsin, trypsin, chymotrypsin, elastase, aminopeptidase, gelatinase B, gelatinase A, α-chymotrypsin, carboxypeptidase, endoproteinase Arg-C, endoproteinase Asp-N, endoproteinase Glu-C, endoproteinase Lys-C, and trypsin, luminal pepsin, microvillar endopeptidase, dipeptidyl peptidase, enteropeptidase, hydrolase, NS3, elastase, factor Xa, Granzyme B, thrombin, trypsin, plasmin, urokinase, tPA and PSA.

Resistance to proteolysis refers to any amount of decreased cleavage of a target amino acid residues of a modified polypeptide by a protease compared to cleavage of an unmodified polypeptide by the same protease under the same conditions. Modified GH polypeptides provided herein exhibit increased resistance to proteolysis exhibits, for example, at least 1%, 2%, 3%, 4%, 5%, 6%, 7%, 8%, 9%, 10%, ... 20%, ... 30%, ... 40%, ... 50%, ... 60%, ..., 70%, ... 80%, ... 90%, 91%, 92%, 93%, 94%, 95%, 96%, 97%, 98%, 99%, or 100% more resistance to proteolysis than an unmodified GH polypeptide.

Modified GH polypeptides that are more resistant to gelatinase B are provided. Modifications that render polypeptides more resistant to cleavage by a gelatinase B than an unmodified GH polypeptide that is cleaved by gelatinase B. Polypeptides are cleaved by gelatinase B at or near a sequence that typically includes Met-Ser-Tyr-Asn or a corresponding sequence. Cleavage can occur within this region or near, such as within 5, 10, 15 or about 20 amino acids C-terminal or N-terminal to this region, The precise amino acids cleaved in a polypeptide by gelatinase B can be determined empirically, if needed. Hence, provided herein are polypeptides that are modified at amino acids in the sequence of amino acids Met-Ser-Tyr-Asn or in corresponding amino acids or in residues that are before or after this sequence or a corresponding sequence. Modified polypeptides can be modified at each of residues Met, Ser, Tyr, Asn, or a combination thereof, or at amino acids near this region, thereby rendering the modified peptide more resistant to proteolysis by gelatinase B than the unmodified polypeptide. The modified polypeptides can be is at least 0.5%, 1%, 5%, 10%, 15%, 20%, 25%, 30%, 35%, 40%, 45%, 50%, 55%, 60%, 65%, 70%, 75%, 80%, 85%, 90%, 95%, 96%, 97%, 98%, 99%, or 100% more resistant to proteolysis by gelatinase B than the unmodified polypeptide. In one embodiment, resistance to protease can be empirically tested by any of the assays described herein.

In one embodiment, positions identified for modification to increase protease resistance include, for example, F1, P2, P5, L9, D11, M14, R16, L23, D26, K41, Y42, E56, E65, E66, L73, E74, L81, L87, L101, Y111, D112, D116, E119, L124, M125, P133, R134, K140, D147, D153, L156, L157, K158, L162, F166, R167, K168, D169, D171, D171Q, K172, E174, L177, R178, and F191. Modified GH polypeptides are identified that exhibit increased protease resistance compared to unmodified hGH, including but not limited to, F11, P2A, P5S, L9V, D11N, M14V, R16H, L23I, L23V, D26N, K41Q, Y42H, Y42I, E56Q, E56N, E65Q, E66Q, L73V, E74N, L81V, L87V, L101V, Y111I, D112N, D116Q, E119Q, L124V, M125I, M125V, P133A, R134A, R134H, K140N, D147N, D147Q, D153N, L156I, L157I, K158N, L162I, F166I, R167H, R167Q, K168N, K168Q, D169Q, D171N, D171Q, K172Q, E174Q, E174N, E174H, L177V, L177I, R178Q, and F191I.

2. Increased Thermal Tolerance

Among the modified GH polypeptides provided herein are GH polypeptides modified to increase stability by improving thermal tolerance. Such modifications can include, for example, increased saline (polar) interactions between helices and increased H-bond interactions between helices.

a. Properties of Thermal Tolerant Modified Growth Hormone Polypeptides

In one example, the modified GH polypeptides that exhibit increased thermal tolerance are human GH polypeptides. 2D-scanning methodology can be used to identify the amino acid changes on GH polypeptides that result in improved thermal tolerance. For example, as described herein, to increase the thermal tolerance of hGH, the first condition is the nature of the amino acids linked to thermal tolerance of the molecule such as its potential participation in chemical bridges that can participate in stabilization of the molecule. The second premise is typically related to the specific position of those amino acids along the protein structure. Several structural modifications can be made in the GH polypeptide sequence by replacing amino acids to increase the conformational stability of the GH polypeptide while either improving or maintaining the requisite activity (e.g., cell proliferation activity). In exemplary embodiments, these modifications result in modified GH polypeptides with improved stability as assessed by increased thermal tolerance. Such modified GH polypeptides exhibit increased protein half-life compared to an unmodified and/or wild-type native GH polypeptide. These modifications include modification of hydrophobic patches to increase polar interactions with solvent and increasing polar interactions between particular helices.

In one embodiment, the half-life in vitro or in vivo (serum stability) of the modified GH polypeptides provided herein is increased by an amount selected from at least 10%, at least 20%, at least 30%, at least 40%, at least 50%, at least 60%, at least 70%, at least 80%, at least 90%, at least 100%, at least 150%, at least 200%, at least 250%, at least 300%, at least 350%, at least 400%, at least 450%, at least 500% or more, when compared to the half-life of a native GH exposed to particular thermal conditions between 20° C. and 45° C. In one example, thermal tolerance is assessed at room temperature (e.g., about 25° C.). In another example, thermal tolerance is assessed at a mammalian body temperature, e.g., about 37° C. for humans. In other embodiments, the half-life in vitro or in vivo (serum stability) of the modified GH polypeptides provided herein is increased by an amount selected from at least 6 times, 7 times, 8 times, 9 times, 10 times, 20 times, 30 times, 40 times, 50 times, 60 times, 70 times, 80 times, 90 times, 100 times, 200 times, 300 times, 400 times, 500 times, 600 times, 700 times, 800 times, 900 times, 1000 times, or more, when compared to the half-life of native GH exposed to particular thermal conditions between 20° C. and 45° C., for example, incubation at room temperature (e.g., about 25° C.) and/or mammalian body temperature (e.g., human body temperature at about 37° C.).

i. Creation of Intra-molecular Bonds

Molecular bonds are created between confronted helices to increase stability of the overall structure and to improve thermal tolerance of the hGH polypeptide. In a particular embodiment, helices A and C were stabilized by either adding charges or increasing polar interactions between these helices. The amino acids and amino acid positions selected as is-HITs are oriented in the region where the helices face each other. Solvent accessibility can be considered for selection of is-HITs.

Is-HITS are identified and LEADS created for higher thermal tolerance of modified hGH polypeptides. The native amino acids at each of the is-HIT positions can include, but are not limited to L6, L9, A13, L15, A17, L20, L23, A24, A105, V110, L113, L114, L117, I121, L124 and L128 (see Table 5). The native amino acid at each of the is-HIT positions was replaced by residues increasing polar interaction with other amino acids: E, D, K, R, N, Q, S, or T.

Is-HITS and LEADs can include modifications at particular regions that contribute to thermal stability. In one embodiment, the regions selected for modification include one or more amino acid modifications in a region corresponding to positions in pituitary hGH (SEQ ID NO:1). Positions in these regions include, for example, positions 1 to 12, 14 to 26, 29 to 53, 57, 58, 60 to 63, 67 to 78, 80 to 84, 86, 87, 89, 91, 93, 95 to 100, 102 to 113, 115 to 128, 131, 132, 135 to 139, 141, 142, 144, 148 to 160, 162 to 182, 185 and 187 to 191. For example, pituitary hGH is modified to include one or more amino acid modifications in amino acid positions corresponding to any of positions 1 to 12, 14 to 26, 29 to 53, 57, 58, 60 to 63, 67 to 78, 80 to 84, 86, 87, 89, 91, 93, 95 to 100, 102 to 113, 115 to 128, 131, 132, 135 to 139, 141, 142, 144, 148 to 160, 162 to 182, 185 and 187 to 191 of SEQ ID NO:1. In another embodiment, a placental hGH is modified. Placental hGH (SEQ ID NO:712) is aligned with pituitary hGH (SEQ ID NO:1), and one or more amino acid positions are chosen from positions 1 to 12, 14 to 26, 29 to 53, 57, 58, 60 to 63, 67 to 78, 80 to 84, 86, 87, 89, 91, 93, 95 to 100, 102 to 113, 115 to 128, 131, 132, 135 to 139, 141, 142, 144, 148 to 160, 162 to 182, 185 and 187 to 191 of pituitary hGH. Alignments and selection of positions can be performed with any GH polypeptide by aligning it with pituitary hGH and selecting corresponding positions for modification.

In one embodiment, positions corresponding to pituitary hGH are selected (is-HITS) and amino acid replacements are made (LEADs) to increased thermal tolerance. In a particular embodiment, amino acid replacements leading to increased thermal tolerance include, for example, to L6E, L6D, L6K, L6R, L6N, L6Q, L6S, L6T, L9E, L9D, L9K, L9R, L9N, L9Q, L9S, L9T, A13E, A13D, A13K, A13R, A13N, A13Q, A13S, A13T, L15E, L15D, L15K, L15R, L15N, L15Q, L15S, L15T, A17E, A17D, A17K, A17R, A17N, A17Q, A17S, A17T, L20E, L20D, L20K, L20R, L20N, L20Q, L20S, L20T, L23E, L23D, L23K, L23R, L23N, L23Q, L23S, L23T, A24E, A24D, A24K, A24R, A24N, A24Q, A24S, A24T, A105E, A105D, A105K, A105R, A105N, A105Q, A105S, A105T, V110E, V110D, V110K, V110R, V110N, V110Q, V110S, V110T, L113E, L113D, L113K, L113R, L113N, L113Q, L113S, L113T, L114E, L114D, L114K, L114R, L114N, L114Q, L114S, L114T, L117E, L117D, L117K, L117R, L117N, L117Q, L117S, L117T, I121E, I121D, I121K, I121R, I121N, I121Q, I121S, I121T, L124E, L124D, L124K, L124R, L124N, L124Q, L124S, L124T, L128E, L128D, L128K, L128R, L128N, L128Q, L128S, and L128T. In one example, such amino acid replacements are made in the pituitary hGH (SEQ ID NO:1; see Table 6 and SEQ ID NOS: 224-351).

ii. Increasing Polar Interactions Between Helices

Hydrophobic regions of helices A and C of hGH polypeptides are protected from exposure to solvent. These hydrophobic regions are created from the interaction of helices A and C and play a role in the overall stabilization of the hGH structure. Changes in the hydrophobic region of helices A and C also can be made to favor polar interactions with the solvent, thereby stabilizing the protein conformation.

In one embodiment, the 2D-scanning process for protein evolution is used to add charges to the hydrophobic region of helices A and C and, thus, increase thermal tolerance. The increase in thermal tolerance can be manifested as increased protein half-life in vitro and/or increased protein half-life in vivo. As described herein, methods for designing and generating highly stable, longer lasting proteins, or proteins having a longer half-life include, for example i) identifying some or all possible target sites on the protein sequence that can participate in the interaction and creation of the hydrophobic region of helices A and C (these sites are referred to herein as is-HITs); ii) identifying appropriate replacing amino acids specific for each is-HIT, such that upon replacement of one or more of the original (such as native) amino acids at that specific is-HIT, the replacements can be expected to increase the is-HIT's stability while at the same time, maintaining or improving the requisite activity and specificity of the protein (candidate LEADs); iii) systematically introducing the specific replacing amino acids (candidate LEADs) at every specific is-HIT target position to generate a library containing the corresponding mutant candidate lead molecules. Modified GH polypeptides are generated and produced. The modified GH polypeptides can then be phenotypically characterized one-by-one in addressable arrays so that each mutant molecule contains initially an amino acid replacement at only one is-HIT site. In particular embodiments, mutant molecules also can be generated in subsequent rounds that contain multiple HIT sites that have been replaced by candidate LEAD amino acids (super-LEADs).

In additional embodiments, these candidate LEADs can be further modified with additional mutations that confer protein stability, such as those described herein. For example, the candidate LEADs can be modified to include, for example, increasing interactions between helices and/or removing protease sensitive sites.

b. Assessment of Thermal Tolerant Modified Growth Hormone Polypeptides

Thermal tolerance of modified GH polypeptides can be assessed by any methods known in the art to assess protein, stability, thermal denaturation and/or activity. In one example, the kinetics of thermal tolerance is measured by testing activity at particular temperatures, e.g., between 20° C. and 45° C. In one example, thermal tolerance is assessed at 37° C. Briefly, modified GH polypeptides is incubated at the selected temperature and samples are taken over time-points to assess residual activity compared to an untreated control. Assessment can include, for example, a cell proliferation assay for GH activity. Thermal tolerance is assessed based on the ability of a modified GH polypeptide to maintain activity over time at a particular temperature compared to the ability of an unmodified GH to maintain activity in similar treatments.

3. Super-LEADs and Additional Growth Hormone Modifications

GH modification also can include combining two or more modifications. For example, two or more LEADs can be combined into a single new molecule. Modifications that increase proteolysis resistance can be combined with other modifications provided herein or known in the art to increase proteolysis resistance. Modifications that increase thermal tolerance can be combined with other modifications provided herein or known in the art to increase thermal tolerance. Modifications that increase thermal tolerance can be combined with modifications provided herein or known in the art to increase proteolysis resistance. Modifications that increase thermal tolerance and/or protease stability also can be combined with modifications to GH that alter other functionalities including activity, receptor interactions, modifications that affect post-translation protein modifications and any other known modifications in the art.

A number of techniques are known for combining modifications in one polypeptide. For example, Additive Directional Mutagenesis (ADM) can be used to assemble on a single mutant protein multiple mutations present on the individual LEAD molecules, so as to generate super-LEAD mutant proteins (see co-pending U.S. application Ser. No. 10/658,355; U.S. Published Application No. US-2004-0132977-A1 and published PCT applications WO 2004/022747 and WO 2004/022593). ADM is a repetitive multi-step process where at each step after the creation of the first LEAD mutant protein, a new LEAD mutation is added onto the previous LEAD mutant protein to create successive super-LEAD mutant proteins.

A population of sets of nucleic acid molecules encoding a collection of new super-LEAD mutant molecules is generated, tested and phenotypically characterized one-by-one in addressable arrays. Super-LEAD mutant molecules are molecules containing variable numbers and types of LEAD mutations. Molecules displaying further improved fitness for the particular feature being evolved are referred to as super-LEADs. Super-LEADs can be generated by other methods known to those of skill in the art and tested by the high throughput methods herein. For purposes herein a super-LEAD typically has activity with respect to the function or activity of interest that differs from the improved activity of a LEAD by a desired amount, such as at least 10%, 20%, 30%, 40%, 50%, 60%, 70%, 80%, 90%, 100%, 150%, 200% or more from at least one of the LEAD mutants from which it is derived. In yet other embodiments, the change in activity is at least about 2 times, 3 times, 4 times, 5 times, 6 times, 7 times, 8 times, 9 times, 10 times, 20 times, 30 times, 40 times, 50 times, 60 times, 70 times, 80 times, 90 times, 100 times, 200 times, 300 times, 400 times, 500 times, 600 times, 700 times, 800 times, 900 times, 1000 times, or more times greater than at least one of the LEAD molecules from which it is derived. As with LEADs, the change in the activity for super-LEADs is dependent upon the activity that is being "evolved." The desired alteration, which can be either an increase or a reduction in activity, depends upon the function or property of interest.

Another method that can be employed to generate combinations of two or more mutations is using oligonucleotide-mediated mutagenesis referred to as "multi-overlapped primer extensions" (see co-pending U.S. application Ser. No. 10/658,355, U.S. Published Application No. US-2004-0132977-A1 and published PCT applications WO 2004/022747 and WO 2004/022593). This method can be used for the rational combination of mutant LEADs to form super-LEADS. This method allows the simultaneous introduction of several mutations throughout a small protein or protein-region of known sequence. Overlapping oligonucleotides of, typically, around 70 bases in length (since longer oligonucleotides lead to increased error) are designed from the DNA sequence (gene) encoding the mutant LEAD proteins so that they overlap with each other on a region of typically around 20 bases. Although, typically, about 70 bases are used to create the overlapping oligonucleotides, the length of additional overlapping oligonucleotides for use can range from about 30 bases up to about 100 bases. Likewise, although the overlapping region of the overlapping oligonucleotides is, typically, about 20 bases, the length of other overlapping regions for use herein can range from about 5 bases up to about 40 bases. These overlapping oligonucleotides (including or excluding point mutations) act as templates and primers in a first step of PCR (using a proofreading polymerase, e.g., Pfu DNA polymerase, to avoid unplanned mutations) to create small amounts of full-length gene. The full-length gene resulting from the first PCR is then selectively amplified in a second step of PCR using flanking primers, each one tagged with a restriction site in order to facilitate subsequent cloning. One multi-overlapped extension process yields a full-length (multi-mutated) nucleic acid molecule encoding a candidate super-LEAD protein having multiple mutations therein derived from LEAD mutant proteins.

E. Production of Modified Growth Hormone Polypeptides
  1. Expression Systems

Human GH polypeptides can be produced by any methods known in the art for protein production, including the introduction of nucleic acid molecules encoding hGH into a host cell, host animal and/or expression from nucleic acid molecules encoding hGH in vitro. Expression hosts include *E. coli*, yeast, plants, insect cells, and mammalian cells, including human cell lines and transgenic animals. Expression hosts can differ in protein production levels as well as the types of post-translational modifications present on the expressed proteins. The choice of expression host can be made based on these, and other factors, such as regulatory and safety considerations, production costs and the need and methods for purification.

Expression in eukaryotic hosts can include expression in yeasts such as *Saccharomyces cerevisae* and *Pichia Pastoria*, insect cells such as *Drosophila* cells and *lepidopteran* cells, plants and plant cells such as tobacco, corn, rice, algae and lemna. Eukaryotic cells for expression also include mammalian cells lines such as Chinese hamster ovary (CHO) cells. Eukaryotic expression hosts also include production in transgenic animals, for example, including production in milk and eggs.

Many expression vectors are available for the expression of hGH. The choice of expression vector is influenced by the choice of host expression system. Such selection is well within the level of skill of the skilled artisan. In general, expression vectors can include transcriptional promoters and optionally enhancers, translational signals, and transcriptional and translational termination signals. Expression vectors that are used for stable transformation typically have a selectable marker which allows selection and maintenance of the transformed cells. In some cases, an origin of replication can be used to amplify the copy number of the vector.

a. Prokaryotic Expression

Prokaryotes, especially *E. coli*, provide a system for producing large amounts of hGH (see for example, Platis et al. *Protein Exp. Purif.* 31(2):222-30 (2003); Khalizzadeh et al. *J. Ind. Microbiol. Biotechnol.* 31(2): 63-69 (2004)). Transformation of *E. coli* is a simple and rapid technique well known to those of skill in the art. Expression vectors for *E. coli* can contain inducible promoters that are useful for inducing high levels of protein expression and for expressing proteins that exhibit some toxicity to the host cells. Examples of inducible promoters include the lac promoter, the trp promoter, the hybrid tac promoter, the T7 and SP6 RNA promoters and the temperature regulated $\lambda P_L$ promoter.

Human GH can be expressed in the cytoplasmic environment of *E. coli*. The cytoplasm is a reducing environment and, for some molecules, this can result in the formation of insoluble inclusion bodies. Reducing agents such as dithiolthreotol and β-mercaptoethanol and denaturants (e.g., guanidine-HCl and urea) can be used to resolubilize the proteins. An alternative approach is the expression of hGH in the periplasmic space of bacteria which provides an oxidizing environment and chaperonin-like and disulfide isomerases and can lead to the production of soluble protein. Typically, a leader sequence is fused to the protein of interest which directs the protein to the periplasm. The leader is then removed by signal peptidases inside the periplasm. Examples of periplasmic-targeting leader sequences include the pelB leader from the pectate lyase gene and the leader derived from the alkaline phosphatase gene. In some cases, periplasmic expression allows leakage of the expressed protein into the culture medium. The secretion of proteins allows quick and simple purification from the culture supernatant. Proteins that are not secreted can be obtained from the periplasm by osmotic lysis. Similar to cytoplasmic expression, in some cases proteins can become insoluble and denaturants and reducing agents can be used to facilitate solubilization and refolding. Temperature of induction and growth also can influence expression levels and solubility. Typically, temperatures between 25° C. and 37° C. are used. Mutations also can be used to increase solubility of expressed proteins. Typically, bacteria produce aglycosylated proteins. Thus, if proteins require glycosylation for function, glycosylation can be added in vitro after purification from host cells.

b. Yeast

Yeasts such as *Saccharomyces cerevisae, Schizosaccharomyces pombe, Yarrowia lipolytica, Kluyveromyces lactis* and *Pichia pastoris* are useful expression hosts for hGH (see for example, Skoko et al. *Biotechnol. Appl. Biochem.* 38(Pt3): 257-265 (2003)). Yeast can be transformed with episomal replicating vectors or by stable chromosomal integration by homologous recombination. Typically, inducible promoters are used to regulate gene expression. Example of such promoters include GAL1, GAL7 and GAL5 and metallothionein promoters such as CUP1. Expression vectors often include a selectable marker such as LEU2, TRP1, HIS3 and URA3 for selection and maintenance of the transformed DNA. Proteins expressed in yeast are often soluble. Co-expression with chaperonins such as Bip and protein disulfide isomerase can improve expression levels and solubility. Additionally, proteins expressed in yeast can be directed for secretion using secretion signal peptide fusions such as the yeast mating type alpha-factor secretion signal from *Saccharomyces cerevisae* and fusions with yeast cell surface proteins such as the Aga2p mating adhesion receptor or the *Arxula adeninivorans* glucoamylase. A protease cleavage site such as for the Kex-2 protease, can be engineered to remove the fused sequences from the polypeptides as they exit the secretion pathway. Yeast also is capable of glycosylation at Asn-X-Ser/Thr motifs.

c. Insects and Insect Cells

Insects and insect cells, particularly using baculovirus expression, are useful for expressing growth hormones, including hGH (see, for example, Muneta et al. *J. Vet. Med. Sci.* 65(2): 219-23 (2003). Insect cells and insect larvae, including expression in the haemolymph, express high levels of protein and are capable of most of the post-translational modifications used by higher eukaryotes. Baculovirus have a restrictive host range which improves the safety and reduces regulatory concerns of eukaryotic expression. Typical expression vectors use a promoter for high level expression such as the polyhedrin promoter of baculovirus. Commonly used baculovirus systems include the baculoviruses such as *Autographa californica* nuclear polyhedrosis virus (Ac-NPV), and the *bombyx mori* nuclear polyhedrosis virus (Bm-NPV) and an insect cell line such as Sf9 derived from *Spodoptera frugiperda, Pseudaletia unipuncta* (A7S) and *Danaus plexippus* (DpN1). For high level expression, the nucleotide sequence of the molecule to be expressed is fused immediately downstream of the polyhedrin initiation codon of the virus. Mammalian secretion signals are accurately processed in insect cells and can be used to secrete the expressed protein into the culture medium. In addition, the cell lines *Pseudaletia unipuncta* (A7S) and *Danaus plexippus* (DpN1) produce proteins with glycosylation patterns similar to mammalian cell systems.

An alternative expression system in insect cells is the use of stably transformed cells. Cell lines such as the Schnieder 2 (S2) and Kc cells (*Drosophila melanogaster*) and C7 cells (*Aedes albopictus*) can be used for expression. The *Drosophila* metallothionein promoter can be used to induce high levels of expression in the presence of heavy metal induction with cadmium or copper. Expression vectors are typically maintained by the use of selectable markers such as neomycin and hygromycin.

d. Mammalian Cells

Mammalian expression systems can be used to express GH polypeptides. Expression constructs can be transferred to mammalian cells by viral infection such as adenovirus or by direct DNA transfer such as liposomes, calcium phosphate, DEAE-dextran and by physical means such as electroporation and microinjection. Expression vectors for mammalian cells typically include an mRNA cap site, a TATA box, a translational initiation sequence (Kozak consensus sequence) and polyadenylation elements. Vectors often include transcriptional promoter-enhancers for high level expression, for example the SV40 promoter-enhancer, the human cytomegalovirus (CMV) promoter and the long terminal repeat of Rous sarcoma virus (RSV). These promoter-enhancers are active in many cell types. Tissue and cell-type promoters and enhancer regions also can be used for expression. Exemplary promoter/enhancer regions include, but are not limited to, those from genes such as elastase I, insulin, immunoglobulin, mouse mammary tumor virus, albumin, alpha-fetoprotein, alpha 1-antitrypsin, beta-globin, myelin basic protein, myosin light chain-2, and gonadotropic releasing hormone gene control. Selectable markers can be used to select for and maintain cells with the expression construct. Examples of selectable marker genes include, but are not limited to, hygromycin B phosphotransferase, adenosine deaminase, xanthine-guanine phosphoribosyl transferase, aminoglycoside phosphotransferase, dihydrofolate reductase and thymidine kinase. Fusion with cell surface signaling molecules such as TCR-ζ and Fc$_\epsilon$RI-γ can direct expression of the proteins in an active state on the cell surface.

Many cell lines are available for mammalian expression including mouse, rat human, monkey, chicken and hamster cells. Exemplary cell lines include but are not limited to CHO, Balb/3T3, HeLa, MT2, mouse NS0 (non-secreting) and other myeloma cell lines, hybridoma and heterohybridoma cell lines, lymphocytes, fibroblasts, Sp2/0, COS, NIH3T3, HEK293, 293S, 2B8, and HKB cells. Cell lines also are available adapted to serum-free media which facilitates purification of secreted proteins from the cell culture media. One such example is the serum free EBNA-1 cell line (Pham et al., *Biotechnol. Bioeng.* 84: 332-42 (2003)).

e. Plants

Transgenic plant cells and plants can be used for the expression of hGH. Expression constructs are typically transferred to plants using direct DNA transfer such as microprojectile bombardment and PEG-mediated transfer into protoplasts, and with *agrobacterium*-mediated transformation. Expression vectors can include promoter and enhancer sequences, transcriptional termination elements and translational control elements. Expression vectors and transformation techniques are usually divided between dicot hosts, such as *Arabidopsis* and tobacco, and monocot hosts, such as corn and rice. Examples of plant promoters used for expression include the cauliflower mosaic virus promoter, the nopaline synthase promoter, the ribose bisphosphate carboxylase promoter and the ubiquitin and UBQ3 promoters. Selectable markers such as hygromycin, phosphomannose isomerase and neomycin phosphotransferase are often used to facilitate selection and maintenance of transformed cells. Transformed plant cells can be maintained in culture as cells, aggregates (callus tissue) or regenerated into whole plants. Transgenic plant cells also can include algae engineered to produce proteins (see for example, Mayfield et al. (2003) *PNAS* 100:438-442). Because plants have different glycosylation patterns than mammalian cells, this can influence the choice to produce hGH in these hosts.

2. Purification

Method for purification of GH polypeptides from host cells depend on the chosen host cells and expression systems. For secreted molecules, proteins are generally purified from the culture media after removing the cells. For intracellular expression, cells can be lysed and the proteins purified from the extract. When transgenic organisms such as transgenic plants and animals are used for expression, tissues or organs can be used as starting material to make a lysed cell extract. Additionally, transgenic animal production can include the production of polypeptides in milk or eggs, which can be collected, and if necessary further the proteins can be extracted and further purified using standard methods in the art.

Growth hormone can be purified using standard protein purification techniques known in the art including but not limited to, SDS-PAGE, size fraction and size exclusion chromatography, ammonium sulfate precipitation and ionic exchange chromatography. Affinity purification techniques also can be utilized to improve the efficiency and purity of the preparations. For example, antibodies, receptors and other molecules that bind GH can be used in affinity purification. Expression constructs also can be engineered to add an affinity tag to a protein such as a myc epitope, GST fusion or His$_6$ and affinity purified with myc antibody, glutathione resin and Ni-resin, respectively. Purity can be assessed by any method known in the art including gel electrophoresis and staining and spectrophotometric techniques.

3. Fusion Proteins

Fusion proteins containing a targeting agent and a modified GH polypeptide also are provided. Pharmaceutical compositions containing such fusion proteins formulated for administration by a suitable route are provided. Fusion proteins are formed by linking in any order the modified GH and an agent, such as an antibody or fragment thereof, growth factor, receptor, ligand and other such agent for directing the mutant protein to a targeted cell or tissue. Linkage can be effected directly or indirectly via a linker. The fusion proteins can be produced recombinantly or chemically by chemical linkage, such as via heterobifunctional agents or thiol linkages or other such linkages. The fusion proteins can contain additional components, such as *E. coli* maltose binding protein (MBP) that aid in uptake of the protein by cells (see, for example, International PCT application No. WO 01/32711).

4. Polypeptide Modification

Modified GH polypeptides can be prepared as naked polypeptide chains or as a complex. For some applications, it can be desirable to prepare modified GH in a "naked" form without post-translational or other chemical modifications. Naked polypeptide chains can be prepared in suitable hosts that do not post-translationally modify GH. Polypeptides also can be prepared in in vitro systems and using chemical polypeptide synthesis. For other applications, particular modifications can be desired including pegylation, albumination, glycosylation, phosphorylation or other known modifications. Such modifications can be made in vitro or for example, by producing the modified GH is a suitable host that produced such modifications.

5. Nucleotide Sequences

Nucleic acid molecules encoding modified GH polypeptides, provided herein, or the fusion protein operationally linked to a promoter, such as an inducible promoter for expression in mammalian cells also are provided. Such promoters include, but are not limited to, CMV and SV40 promoters; adenovirus promoters, such as the E2 gene promoter, which is responsive to the HPV E7 oncoprotein; a PV promoter, such as the PBV p89 promoter that is responsive to the PV E2 protein; and other promoters that are activated by the HIV or PV or oncogenes.

Modified GH polypeptides provided herein, also can be delivered to cells in gene transfer vectors. The transfer vectors also can encode additional therapeutic agent(s) for treatment of a growth hormone-mediated disease or condition for treatment of growth deficiencies, HIV infection, and others for which the modified GH is administered. Transfer vectors encoding modified GH polypeptides can be used systemically by administering the nucleic acid to a subject. For example, the transfer vector can be a viral vector, such as an adenovirus vector. Vectors encoding GH also can be incorporated into stem cells and administering the stem cells to a subject by transplanting or engrafting the stem cells at sites for therapy.

F. Assessing Modified Growth Hormone Polypeptide Activity(ies)

GH activity can be assessed in vitro and/or in vivo. For example, GH variants can be assessed in vivo in comparison to unmodified and/or wild-type GH. GH variants also can be tested in vivo to ascertain activity, stability (e.g., half-life) and therapeutic effect. In vivo assays include GH assays in animal models as well as administration to humans.

1. In Vitro Assays

In vitro assays include assays for protein stability and activity. Stability assays can include determination of protease resistance, thermal stability and other protein structure and conformational assays known in the art. Assays for activity can include measurement of GH interaction with its receptor or cell-based assays to determine the effect of GH variants on GH cellular pathways. One example of a biological assay is a cell-based proliferation assay. Briefly, modified GH polypeptides are tested for their ability to stimulate cell proliferation in cell lines such as Nb2-11C cells (rat lymphoma cell line). Cells are treated with an unmodified GH or a modified GH polypeptide. After incubation, proliferation of the cells is measured, for example, by cell counting and/or by measuring the number of viable cells (e.g., using a viable stain). "Potency" can be calculated by measuring concentration of a GH and its activity (i.e., cell proliferation activity) compared to the "potency" of an unmodified and/or wild-type GH polypeptide.

2. Non-human Animal Models

Non-human animal models are useful tools to assess activity and stability of growth hormone variants. For example, non-human animals can be used as models for a disease or condition. Non-human animals can be injected with disease and/or phenotype-inducing substances and then growth hormone variants administered to monitor the effects on disease progression. Genetic models also are useful. Animals such as mice can be generated which mimic a disease or condition by the overexpression, underexpression or knock-out of one or more genes. Such animals can be generated by transgenic animal production techniques well-known in the art or using naturally-occurring or induced mutant strains. Examples of useful non-human animal models of diseases associated with growth retardation include, but are not limited to dwarf animals including the growth hormone deficient dwarf rat of the Lewis strain (dw/dw), spontaneous dwarf rat (SDR); growth hormone deficient dwarf mouse (lit/lit or "little mice"), Ames dwarf mouse (Prop11$^{df}$), Bayer dwarf mouse, Snell's dwarf mouse (Pit1$^{dw}$); dwarfed strains of pigs, poodles and Brahmin cattle; growth hormone receptor knockout mice (GHR−/−); hypophysectomized animals such as rats; animal species and strains resistant to growth hormone effects including Guinea pigs and the Laron mouse.

These non-human animal models can be used to monitor activity of growth hormone variants compared to wild type growth hormone. The most common type of in vivo bioassay of GH activity is body weight gain in hypophysectomized rats (Evans et al. *Endocrinology* 22: 483-492 (1938); Marx et al. *Endocrinology* 30: 1-10 (1942); and Greesbeck et al. *Endocrinology* 120: 2582-2590 (1987)) or in dwarf "little" mice (Bellini et al. *Endocrinology* 132: 2051-2055 (1993)). Briefly, dwarf mice can be treated with continuous subcutaneous administration of mutant or wild type GH via osmotic mini pumps. Following the treatment protocol, variables indicative of GH activity include, but are not limited to, body weight gain, changes in body composition (water, fat, protein in relation to body mass), IGF-I or IGFBP-3 production, levels of growth hormone receptor mRNA (as measured, for example, by RT-PCR), fasting lipid profiles, blood glucose and insulin levels can be measured.

Another common type of in vivo bioassay of GH activity is the tibial plate assay on hypophysectomized rats (Greespan et al. *Endocrinology* 45: 455-463 (1949)). Briefly, hypophysectomy is carried out in pre-pubescent male rats. Animals that gain less than 2 grams per week over a 2 week period are selected for GH infusion. Mini osmotic pumps are filled with a modified GH polypeptide and placed under the subcutis of the abdomen. Food and water intake as well as body weight are measured prior to, and during, the administration protocol. Animals are bled by aortic puncture and serum analyzed by RIA or ELISA to assess serum concentrations of hormones. Epiphyseal width is determined by analysis of silverstained tibiae under a stereomicroscope and growth rate can be assessed by measuring accumulated longitudinal bone growth in methacrylate-embedded tibia sections by incident light fluorescence microscopy.

Other suitable non-human animal models useful in the identification and testing of GH variants for the treatment of other diseases and disorders characterized by alterations in GH regulation and activity include, but are not limited to, SIV (simian immunodeficiency virus)–infected macaque model of AIDS wasting; cftr–/– mouse model of cystic fibrosis; mdr1a–/– or SAMP1/Yit mouse models of Crohn's disease; and nephrectomized mouse or rat models of chronic kidney disease.

Animal models can further be used to monitor stability, half-life and clearance of growth hormone variants. Such assays can be useful for comparing growth hormone variants and for calculating doses and dose regimens for further non-human animal and human trials. For example, a modified growth hormone can be injected into the tail vein of mice. Blood samples are then taken at time-points after injection (such as minutes, hours and days afterwards) and then the level of the growth hormone variant in bodily samples including, but not limited to serum or plasma can be monitored at specific time-points, for example, by ELISA or radioimmunoassay.

3. Clinical Assays

Many assays are available to assess activity of growth hormone for clinical use. Such assays include assessment of receptor binding, receptor activation, protein stability and half-life in vivo and phenotypic assays. Exemplary assays include, but are not limited to, in vitro GH bioassays suitable for clinical use such as radioreceptor assays (Tsushima et al., *J. Clin. Endocrinol. Metab.* 37: 344-337 (1973); and Lesniak et al. *Nature* 241: 20-22 (1973)), receptor modulation assays (Rosenfeld et al. *J. Clin. Endocrinol. Metab.* 50: 62-69 (1980)), and cell proliferation bioassays using the Nb2 cell line (Tanaka et al. *J. Clin. Endocrinol. Metab.* 51: 1058-1063 (1980)). Other techniques can include using a mouse pro-B cell lymphoma cell line expressing the hGH receptor to establish a bioassay system for hGH in measuring levels in subject sera (Ishikawa et al. *Journal of Clinical Endocrinology & Metabolism* 85(11): 4274-4279 (2000)).

Phenotypic assays and assays to assess the therapeutic effect of GH treatment include assessment of blood levels of GH (e.g., measurement of serum GH and anterior pituitary hormones prior to administration and time-points following administrations including, after the first administration, immediately after last administration, and time-points in between, correcting for the body mass index (BMI)), phenotypic response to GH treatment including amelioration of symptoms over time compared to subjects treated with an unmodified and/or wild type GH or placebo. For example, in treatments to stimulate growth, assays can include growth rate measurements, and measurement of serum levels of IGF-I, IGFBP-3, and GHRH. Fasting lipid profiles, glucose and insulin also can be measured by radioimmunoassay.

G. Formulation/Administration

Pharmaceutical compositions containing variants produced herein, including hGH variant polypeptides, hGH fusion proteins or encoding nucleic acid molecules, can be formulated in any conventional manner by mixing a selected amount of the polypeptide with one or more physiologically acceptable carriers or excipients. Selection of the carrier or excipient is within the skill of the administering profession and can depend upon a number of parameters. These include, for example, the mode of administration (i.e., systemic, oral, nasal, pulmonary, local, topical or any other mode) and disorder treated. The pharmaceutical compositions provided herein can be formulated for single dosage (direct) administration or for dilution or other modification. The concentrations of the compounds in the formulations are effective for delivery of an amount, upon administration, that is effective for the intended treatment. Typically, the compositions are formulated for single dosage administration. To formulate a composition, the weight fraction of a compound or mixture thereof is dissolved, suspended, dispersed or otherwise mixed in a selected vehicle at an effective concentration such that the treated condition is relieved or ameliorated. Pharmaceutical carriers or vehicles suitable for administration of the compounds provided herein include any such carriers known to those skilled in the art to be suitable for the particular mode of administration.

The polypeptides can be formulated as the sole pharmaceutically active ingredient in the composition or can be combined with other active ingredients. The polypeptides can be targeted for delivery, such as by conjugation to a targeting agent, such as an antibody. Liposomal suspensions, including tissue-targeted liposomes, also can be suitable as pharmaceutically acceptable carriers. These can be prepared according to methods known to those skilled in the art. For example, liposome formulations can be prepared as described in U.S. Pat. No. 4,522,811. Liposomal delivery also can include slow release formulations, including pharmaceutical matrices such as collagen gels and liposomes modified with fibronectin (see, for example, Weiner et al. *J. Pharm. Sci.* 74(9): 922-5 (1985)).

The active compound is included in the pharmaceutically acceptable carrier in an amount sufficient to exert a therapeutically useful effect in the absence of undesirable side effects on the subject treated. The therapeutically effective concentration can be determined empirically by testing the compounds in known in vitro and in vivo systems, such as the assays provided herein. The active compounds can be administered by any appropriate route, for example, orally, nasally, pulmonarily, parenterally, intravenously, intradermally, subcutaneously, or topically, in liquid, semi-liquid or solid form and are formulated in a manner suitable for each route of administration.

The modified hGH and physiologically acceptable salts and solvates can be formulated for administration by inhalation (either through the mouth or the nose), oral, pulmonary, transdermal, parenteral or rectal administration. For administration by inhalation, the modified hGH can be delivered in the form of an aerosol spray presentation from pressurized packs or a nebulizer with the use of a suitable propellant, e.g., dichlorodifluoromethane, trichlorofluoromethane, dichlorotetrafluoroethane, carbon dioxide or other suitable gas. In the case of a pressurized aerosol, the dosage unit can be determined by providing a valve to deliver a metered amount. Capsules and cartridges of e.g., gelatin for use in an inhaler or insufflator, can be formulated containing a powder mix of a therapeutic compound and a suitable powder base such as lactose or starch.

For pulmonary administration to the lungs, the modified hGH can be delivered in the form of an aerosol spray presentation from a nebulizer, turbonebulizer, or microprocessor-controlled metered dose oral inhaler with the use of a suitable propellant. Generally, particle size of the aerosol spray is small, such as in the range of 0.5 to 5 microns. In the case of a pharmaceutical composition formulated for pulmonary administration, detergent surfactants are not typically used. Pulmonary drug delivery is a promising non-invasive method of systemic administration. The lungs represent an attractive route for drug delivery, mainly due to the high surface area for absorption, thin alveolar epithelium, extensive vascularization, lack of hepatic first-pass metabolism, and relatively low metabolic activity.

The modified hGH polypeptides can be formulated as a depot preparation. Such long-acting formulations can be administered by implantation (for example, subcutaneously or intramuscularly) or by intramuscular injection. Thus, for example, the therapeutic compounds can be formulated with suitable polymeric or hydrophobic materials (for example, as an emulsion in an acceptable oil), ion exchange resins, or as sparingly soluble derivatives, for example, as a sparingly soluble salt.

The modified hGH can be formulated for parenteral administration by injection (e.g., by bolus injection or continuous infusion. Formulations for injection can be presented in unit dosage form (e.g., in ampoules or in multi-dose containers) with an added preservative. The compositions can take such forms as suspensions, solutions or emulsions in oily or aqueous vehicles and can contain formulatory agents such as suspending, stabilizing and/or dispersing agents. Alternatively, the active ingredient can be in powder-lyophilized form for constitution with a suitable vehicle, e.g., sterile pyrogen free water, before use.

The active agents can be formulated for local or topical application, such as for topical application to the skin (transdermal) and mucous membranes, such as in the eye, in the form of gels, creams, and lotions and for application to the eye or for intracisternal or intraspinal application. Such solutions, particularly those intended for ophthalmic use, can be formulated as 0.01%-10% isotonic solutions and pH about 5-7 with appropriate salts. The compounds can be formulated as aerosols for topical application, such as by inhalation (see, for example, U.S. Pat. Nos. 4,044,126, 4,414,209 and 4,364,923, which describe aerosols for delivery of a steroid useful for treatment inflammatory diseases, particularly asthma).

The concentration of active compound in the drug composition depends on absorption, inactivation and excretion rates of the active compound, the dosage schedule, and amount administered as well as other factors known to those of skill in the art. As described further herein, dosages can be determined empirically using dosages known in the art for administration of unmodified hGH and comparisons of properties and activities (e.g., stability and activity) of the modified hGH compared to the unmodified and/or native hGH.

The pharmaceutical compositions, if desired, can be presented in a package, in a kit or dispenser device, that can contain one or more unit dosage forms containing the active ingredient. The package, for example, contains metal or plastic foil, such as a blister pack. The pack or dispenser device can be accompanied by instructions for administration. The pharmaceutical compositions containing the active agents can be packaged as articles of manufacture containing packaging material, an agent provided herein, and a label that indicates the disorder for which the agent is provided.

Among the modified GH polypeptides provided herein are modified GH polypeptides to increase stability to conditions amendable to oral delivery. Oral delivery can include administration to the mouth and/or gastrointestinal tract. Such modifications can include increased protein-half life under one or more conditions such as exposure to saliva, exposure to proteases in the gastrointestinal tract, and exposure to particular pH conditions, such as the low pH of the stomach and/or pH conditions in the intestine. Modifications can include resistance to one or more proteases in low pH of the stomach including gelatinase A and gelatinase B. Modifications also can include increasing overall stability to potentially denaturing or conformation-altering conditions such as thermal tolerance, and tolerance to mixing and aeration (e.g., chewing).

Growth hormone polypeptides modified for suitability to oral delivery can be prepared using any of the methods described herein. For example, 2D- and 3D-scanning mutagenesis methods for protein rational evolution (see, co-pending U.S. application Ser. No. 10/685,355 and U.S. Published Application No. US-2004-0132977-A1 and published International applications WO 2004/022593 and WO 2004/022747) can be used to prepare modified GH polypeptides. Modification of GH for suitability for oral delivery can include removal of proteolytic digestion sites in a GH and/or increasing the overall stability of the GH structure. Such modified GHs exhibit increased in protein half-life compared to an unmodified and/or wild-type native GH in one or more conditions for oral delivery. For example, a modified GH can have increased protein half-life and/or bioavailability in the mouth, throat (e.g., through the mucosal lining), the gastrointestinal tract or systemically.

In one embodiment, the half-life in vitro or in vivo (serum stability) of the modified GHs provided herein is increased by an amount selected from at least 10%, at least 20%, at least 30%, at least 40%, at least 50%, at least 60%, at least 70%, at least 80%, at least 90%, at least 100%, at least 150%, at least 200%, at least 250%, at least 300%, at least 350%, at least 400%, at least 450%, at least 500% or more, when compared to the half-life of a native GH exposed to one or more conditions for oral delivery. In other embodiments, the half-life in vitro or in vivo (serum stability) of the modified GHs provided herein is increased by an amount selected from at least 6 times, 7 times, 8 times, 9 times, 10 times, 20 times, 30 times, 40 times, 50 times, 60 times, 70 times, 80 times, 90 times, 100 times, 200 times, 300 times, 400 times, 500 times, 600 times, 700 times, 800 times, 900 times, 1000 times, or more, when compared to the half-life of native GH exposed to one or more conditions for oral delivery.

In one example, half-life of the modified GH is assessed by increased half-life in the presence of one or more proteases. The modified GH can be mixed with one or more proteases and then assessed for activity and/or protein structure after a suitable reaction time. Assessment of half-life also can include exposure to increased temperature, such as the body temperature of a subject; exposure to gastric juices and/or simulated gastric juices; exposure to particular pH conditions and/or a combination of two or more conditions. Following exposure to one or more conditions, activity and/or assessment of GH structure can be used to assess the half-life of the modified GH in comparison to an appropriate control (i.e., an unmodified and/or wildtype GH protein).

The modified hGH polypeptides can be formulated for oral administration, such as in tablets, capsules, liquids or other suitable vehicle for oral administration. Preparation of pharmaceutical compositions containing a modified GH for oral delivery can include formulating modified GH with oral formulations known in the art and described herein. The compositions as formulated do not require addition of protease inhibitors and/or other ingredients that are necessary for stabilization of unmodified and wild-type GH upon exposure of proteases, pH and other conditions of oral delivery. For example, such compositions exhibit stability in the absence of compounds such as actinonin or epiactinonin and derivatives thereof; Bowman-Birk inhibitor and conjugates thereof; aprotinin and camostat.

Additionally, because modified GH provided herein exhibit increased protein stability, there is more flexibility in the administration of pharmaceutical compositions than their unmodified counterparts. Typically, orally ingested GH are administered in the morning before eating (i.e., before digestive enzymes are activated). The modified GH herein exhibit protease resistance to digestive enzymes and can offer the ability to administer pharmaceutical compositions containing a modified GH at other periods during the day and under conditions when digestive enzymes are present and active.

For oral administration, the pharmaceutical compositions can take the form of, for example, tablets or capsules prepared by conventional means with pharmaceutically acceptable excipients such as binding agents (e.g., pregelatinized maize starch, polyvinylpyrrolidone or hydroxypropyl methylcellulose); fillers (e.g., lactose, microcrystalline cellulose or calcium hydrogen phosphate); lubricants (e.g., magnesium stearate, talc or silica); disintegrants (e.g., potato starch or sodium starch glycolate); or wetting agents (e.g., sodium lauryl sulphate). The tablets can be coated by methods well known in the art. Tablets can be taken as supplements to increase muscle mass. Liquid preparations for oral administration can take the form of, for example, solutions, syrups or suspensions, or they can be presented as a dry product for constitution with water or other suitable vehicle before use. Such liquid preparations can be prepared by conventional means with pharmaceutically acceptable additives such as suspending agents (e.g., sorbitol syrup, cellulose derivatives or hydrogenated edible fats); emulsifying agents (e.g., lecithin or acacia); non aqueous vehicles (e.g., almond oil, oily esters, ethyl alcohol or fractionated vegetable oils); and preservatives (e.g., methyl or propyl p hydroxybenzoates or sorbic acid). The preparations also can contain buffer salts, flavoring, coloring and/or sweetening agents as appropriate.

Preparations for oral administration can be formulated to give controlled or sustained release or for release after passage through the stomach or in the small intestine of the active compound. For oral administration the compositions can take the form of tablets, capsules, liquids, lozenges and other forms suitable for oral administration. Formulations suitable for oral administration include lozenges and other formulations that deliver the pharmaceutical composition to the mucosa of the mouth, throat and/or gastrointestinal tract. Lozenges can be formulated with suitable ingredients including excipients for example, anhydrous crystalline maltose and magnesium stearate. As noted, modified GHs herein exhibit resistance to blood or intestinal proteases and can be formulated without additional protease inhibitors or other protective compounds. Preparations for oral administration also can include a modified GH resistant to proteolysis formulated with one or more additional ingredients that also confer protease resistance or stability in other conditions, such as particular pH conditions.

Also provided are pharmaceutical compositions of nucleic acid molecules encoding the hGH polypeptides and expression vectors encoding them that are suitable for gene therapy. Rather than deliver the protein, nucleic acid molecules can be administered in vivo (e.g., systemically or by other routes), or ex vivo, such as by removal of cells, including lymphocytes, introduction of the nucleic therein, and reintroduction into the host or a compatible recipient.

Human GH polypeptides can be delivered to cells and tissues by expression of nucleic acid molecules. Human GH polypeptides can be administered as nucleic acid molecules encoding hGH polypeptides, including ex vivo techniques and direct in vivo expression.

Nucleic acids can be delivered to cells and tissues by any method known to those of skill in the art. The isolated nucleic acid sequences can be incorporated into vectors for further manipulation. As used herein, vector (or plasmid) refers to discrete elements that are used to introduce heterologous DNA into cells for either expression or replication thereof. Selection and use of such vehicles are well within the skill of the artisan.

Methods for administering hGH polypeptides by expression of encoding nucleic acid molecules include administration of recombinant vectors. The vector can be designed to remain episomal, such as by inclusion of an origin of replication or can be designed to integrate into a chromosome in the cell. Human GH polypeptides also can be used in ex vivo gene expression therapy using non-viral vectors. For example, cells can be engineered to express a hGH polypeptide, such as by integrating a hGH polypeptide encoding-nucleic acid into a genomic location, either operatively linked to regulatory sequences or such that it is placed operatively linked to regulatory sequences in a genomic location. Such cells then can be administered locally or systemically to a subject, such as a patient in need of treatment.

Viral vectors, include, for example adenoviruses, herpes viruses, retroviruses and others designed for gene therapy can be employed. The vectors can remain episomal or can integrate into chromosomes of the treated subject. A hGH polypeptide can be expressed by a virus, which is administered to a subject in need of treatment. Virus vectors suitable for gene therapy include adenovirus, adeno-associated virus, retroviruses, lentiviruses and others noted above. For example, adenovirus expression technology is well-known in the art and adenovirus production and administration methods also are well known. Adenovirus serotypes are available, for example, from the American Type Culture Collection (ATCC, Rockville, Md.). Adenovirus can be used ex vivo. For example, cells are isolated from a patient in need of treatment, and transduced with a hGH polypeptide-expressing adenovirus vector. After a suitable culturing period, the transduced cells are administered to a subject locally and/or systemically. Alternatively, hGH polypeptide-expressing adenovirus particles are isolated and formulated in a pharmaceutically-acceptable carrier for delivery of a therapeutically effective amount to prevent, treat or ameliorate a disease or condition of a subject. Typically, adenovirus particles are delivered at a dose ranging from 1 particle to $10^{14}$ particles per kilogram subject weight, generally between $10^6$ or $10^8$ particles to $10^{12}$ particles per kilogram subject weight. In some situations it is desirable to provide a nucleic acid source with an agent that targets cells, such as an antibody specific for a cell surface membrane protein or a target cell, or a ligand for a receptor on a target cell.

The nucleic acid molecules can be introduced into artificial chromosomes and other non-viral vectors. Artificial chromosomes, such as ACES (see, Lindenbaum et al. *Nucleic Acids Res.* 32(21): e172 (2004)) can be engineered to encode and express the isoform. Briefly, mammalian artificial chromosomes (MACs) provide a means to introduce large payloads of genetic information into the cell in an autonomously replicating, non-integrating format. Unique among MACs, the mammalian satellite DNA-based Artificial Chromosome Expression (ACE) can be reproducibly generated de novo in cell lines of different species and readily purified from the host cells' chromosomes. Purified mammalian ACEs can then be re-introduced into a variety of recipient cell lines where they have been stably maintained for extended periods in the absence of selective pressure using an ACE System. Using this approach, specific loading of one or two gene targets has been achieved in LMTK(−) and CHO cells.

In yet another method is a two-step gene replacement technique in yeast, starting with a complete adenovirus genome (Ad2; Ketner et al. *Proc. Natl. Acad. Sci. USA* 91: 6186-6190

(1994)) cloned in a Yeast Artificial Chromosome (YAC) and a plasmid containing adenovirus sequences to target a specific region in the YAC clone, an expression cassette for the gene of interest and a positive and negative selectable marker.

The nucleic acids encoding the modified GH polypeptides can be encapsulated in a vehicle, such as a liposome, or introduced into a cell, such as a bacterial cell, particularly an attenuated bacterium or introduced into a viral vector. For example, when liposomes are employed, proteins that bind to a cell surface membrane protein associated with endocytosis can be used for targeting and/or to facilitate uptake, e.g., capsid proteins or fragments thereof tropic for a particular cell type, antibodies for proteins which undergo internalization in cycling, and proteins that target intracellular localization and enhance intracellular half-life.

For ex vivo and in vivo methods, nucleic acid molecules encoding the hGH polypeptides are introduced into cells that are from a suitable donor or the subject to be treated. Cells into which a nucleic acid can be introduced for purposes of therapy include, for example, any desired, available cell type appropriate for the disease or condition to be treated, including but not limited to epithelial cells, endothelial cells, keratinocytes, fibroblasts, muscle cells, hepatocytes; blood cells such as T lymphocytes, B lymphocytes, monocytes, macrophages, neutrophils, eosinophils, megakaryocytes, granulocytes; various stem or progenitor cells, in particular hematopoietic stem or progenitor cells, e.g., such as stem cells obtained from bone marrow, umbilical cord blood, peripheral blood, fetal liver, and other sources thereof.

For ex vivo treatment, cells from a donor compatible with the subject to be treated or the subject to be treated cells are removed, the nucleic acid is introduced into these isolated cells and the modified cells are administered to the subject. Treatment includes direct administration, such as, for example, encapsulated within porous membranes, which are implanted into the patient (see, e.g., U.S. Pat. Nos. 4,892,538 and 5,283,187). Techniques suitable for the transfer of nucleic acid into mammalian cells in vitro include the use of liposomes and cationic lipids (e.g., DOTMA, DOPE and DC-Chol) electroporation, microinjection, cell fusion, DEAE-dextran, and calcium phosphate precipitation methods. Methods of DNA delivery can be used to express hGH polypeptides in vivo. Such methods include liposome delivery of nucleic acids and naked DNA delivery, including local and systemic delivery such as using electroporation, ultrasound and calcium-phosphate delivery. Other techniques include microinjection, cell fusion, chromosome-mediated gene transfer, microcell-mediated gene transfer and spheroplast fusion.

In vivo expression of a hGH polypeptide can be linked to expression of additional molecules. For example, expression of a hGH polypeptide can be linked with expression of a cytotoxic product such as in an engineered virus or expressed in a cytotoxic virus. Such viruses can be targeted to a particular cell type that is a target for a therapeutic effect. The expressed hGH polypeptide can be used to enhance the cytotoxicity of the virus.

In vivo expression of a hGH polypeptide can include operatively linking a hGH polypeptide encoding nucleic acid molecule to specific regulatory sequences such as a cell-specific or tissue-specific promoter. Human GH polypeptides also can be expressed from vectors that specifically infect and/or replicate in target cell types and/or tissues. Inducible promoters can be use to selectively regulate hGH polypeptide expression.

Nucleic acid molecules in the form of naked nucleic acids or in vectors, artificial chromosomes, liposomes and other vehicles can be administered to the subject by systemic administration, topical, local and other routes of administration. When systemic and in vivo, the nucleic acid molecule or vehicle containing the nucleic acid molecule can be targeted to a cell.

Administration also can be direct, such as by administration of a vector or cells that typically targets a cell or tissue. For example, tumor cells and proliferating can be targeted cells for in vivo expression of hGH polypeptides. Cells used for in vivo expression of a hGH polypeptide also include cells autologous to the patient. These cells can be removed from a patient, nucleic acids for expression of a hGH polypeptide introduced, and then administered to a patient such as by injection or engraftment.

Polynucleotides and expression vectors provided herein can be made by any suitable method. Further provided are nucleic acid vectors containing nucleic acid molecules as described above, including a nucleic acid molecule containing a sequence of nucleotides that encodes the polypeptide as set forth in any of SEQ ID NOS: 2-69, 75, 76, 85-107, 111, 112, 115, 116, 119, 120, 123-154, 164-165, 176-216, 222 and 223 or a functional fragment thereof. Further provided are nucleic acid vectors containing nucleic acid molecules as described above and cells containing these vectors.

H. Therapeutic Uses

The modified GH polypeptides and nucleic acid molecules provided herein can be used for treatment of any condition for which unmodified GH is employed. This section provides exemplary uses of modified GH polypeptides and administration methods. These described therapies are exemplary and do not limit the applications of GH.

The modified GH polypeptides provided herein are intended for use in various therapeutic as well as diagnostic methods in which GH is used for treatment. Such methods include, but are not limited to, methods of treatment of physiological and medical conditions described and listed below. By virtue of their improved stability, modified GH polypeptides provided herein exhibit improvement in the corresponding in vivo activities and therapeutic effects.

In particular, the modified GH polypeptides are intended for use in therapeutic methods in which the natural protein has been used for treatment. Treatment of disorders can include, but are not limited to, growth deficiency disorders (including but not limited to Turner's syndrome, intrauterine growth retardation, idiopathic short stature, Prader Willi syndrome, Thalassaemia), AIDS wasting, aging, impaired immune function of HIV-infected subjects, catabolic illnesses (including those associated with respiratory failure and burn injuries), recovery from surgery, congestive cardiomyopathy, liver transplantation, liver regeneration after hepatectomy, chronic renal failure, renal osteodystrophy, osteoporosis, achondroplasia/hypochondroplasia, skeletal dysplasia, chronic inflammatory or nutritional disorders (such as Crohn's disease), short bowel syndrome, juvenile chronic arthritis, cystic fibrosis, male infertility, X-linked hypophosphatemic rickets, Down's syndrome, Spina bifida, Noonan Syndrome, obesity, impaired muscle strength and fibromyalgia. The modified GH polypeptides and nucleic acid molecules encoding modified GH polypeptides also can be administered in combination with other therapies including other biologics and small molecule compounds.

Treatment of diseases and conditions with modified GH polypeptides can be effected by any suitable route of administration using suitable formulations as described herein, including but not limited to, subcutaneous injection, oral, nasal, pulmonary and transdermal administration. If necessary, a particular dosage and duration and treatment protocol can be empirically determined or extrapolated. For example, exemplary doses of recombinant and native GH polypeptides can be used as a starting point to determine appropriate dosages. Modified GH polypeptides that are more stable and have an increased half-life in vivo can be effective at reduced dosage amounts and or frequencies. Dosages provided herein for treatments and therapies with GH and recombinant forms are exemplary dosages. Such exemplary dosages, however, can provide guidance in selecting dosing regimes for GH variants. Since the mutant GH polypeptides provided herein exhibit increased stability, dosages and administration regimens can differ from those for the unmodified growth hormones. Particular dosages and regimens can be empirically determined.

Dosage levels would be apparent to one of skill in the art and would be determined based on a variety of factors, such as body weight of the individual, general health, age, the activity of the specific compound employed, sex, diet, time of administration, rate of excretion, drug combination, the severity and course of the disease or condition, and the subject's disposition to the disease/condition and the judgment of the treating physician. The amount of active ingredient that can be combined with the carrier materials to produce a single dosage form with vary depending upon the subject treated and the particular mode of administration.

Upon improvement of a subject's condition, a maintenance dose of a compound or composition provided herein can be administered, if necessary; and the dosage, the dosage form, or frequency of administration, or a combination thereof, can be varied. In some cases, the subject can require intermittent treatment on a long-term basis upon any recurrence of disease symptoms.

1. Growth Deficiencies

The growth of an infant into an adult is a complex process involving a number of genes and hormones, as well as nutrition, diet, exercise, and rest. Growth hormone is central to growth and development, and is the principal hormone governing height in an individual. Growth hormone deficiency is a disease often caused by a problem in the pituitary gland or the hypothalamus in the brain. Growth hormone deficiency can result either when GH is not present in the pituitary gland in adequate amounts or when GH is present in adequate amounts but the hormone required to release it (GHRH) is lacking. Growth retardation is a medical condition in which the normal growth of children is slowed down or stopped, due to a deficiency in the growth hormone (GH) system.

There are two different types of GH deficiencies in children: congenital and acquired.

Congenital growth hormone deficiencies arise from problems with the pituitary gland or hypothalamus while the fetus is growing in the womb, whereas acquired growth hormone deficiencies occur when the area around the pituitary and hypothalamus is damaged in some way. In some instances, growth hormone deficiencies can not have an identifiable cause ("idiopathic"). Such instances include Prader-Willi Syndrome (a congenital disorder that features GH deficiency and short stature), Turner's Syndrome (a genetic defect that is manifested only in girls and characterized by short stature), chronic renal insufficiency (kidney malfunction, which can often cause growth retardation in children), and Thalassaemia (an inherited condition characterized by imbalance in the synthesis of hemoglobin causing severe anemia and malformed red blood cells that can cause reduced GH secretion and short stature).

Growth deficiencies not only affect children, but also can be a significant problem for adults. GH deficiency in adults is a specific clinical syndrome with numerous physiological consequences, including, but not limited to: changes in body composition, including central obesity; lipids in the blood; muscle strength; bone composition; exercise capacity and energy; cardiovascular risk; and psychological well-being (e.g., social isolation and depression). Additionally, studies indicate that subjects with hypo-pituitarism have an increased risk of mortality from cardiovascular disease, possibly attributable to their GH deficiency. GH deficiency in adults can result from a pituitary or peri-pituitary tumor, or as a direct result of the surgery/radiation used to manage these conditions. Less commonly, GH deficiency in adults arises from a deficiency acquired in childhood.

Recombinant GH, used as therapeutic treatment for growth deficiency supplements and/or replaces GH the body should normally produce. Treatments for adults and children can include systemic administration of GH. For example, GH can be administered alone or in combination with, prior to, intermittently with, or subsequent to other treating agents. Modes of administration include, but are not limited to, GH injection. The modified GH polypeptides and nucleic acids encoding modified GHs described herein can be used in growth-deficiency therapies. The modified GHs herein exhibit increased protein stability and improved half-life, thereby improving therapeutic efficacy of a pharmaceutical composition. Thus, modified GH can be used to deliver longer lasting, more stable growth-deficiency therapies. Examples of therapeutic improvements using modified GH include, for example, but are not limited to, lower dosages, fewer and/or less frequent administrations, decreased side effects and increased therapeutic effects.

Dosages and regimens of modified GHs provided herein can be empirically determined. For example, because of the improvement in properties, such as serum stability, dosages can be lower than comparable amounts of unmodified GH. Dosages for unmodified GH can be used as guidance for determining dosages for modified GH. Factors such as the level of activity and half-life of a modified GH in comparison to an unmodified GH can be used in making such determinations.

Among the goals of GH therapy for the treatment of growth deficiency is long-term replacement of GH to physiologic levels comparable to healthy persons of same sex and similar age. Dosing regimens of GH can depend upon a number of factors including, but not limited to, age of subject; pubertal status; subject tolerance and incidence of adverse effects; and the source of the GH, whether recombinant or natural. For example, the potency of recombinant GH is about one-third the potency of pituitary GH. Particular doses and dosing regimes can be determined empirically. Exemplary doses of unmodified pituitary GH can be 0.1 mg/kg/wk (0.3 IU/kg/wk); exemplary doses of recombinant unmodified GH can be 0.18 to 0.3 mg/kg/wk for children with GHD (MacGillivray et al. *Pediatrics* 102: 527-530 (1998)). The average dose of GH given to children with growth hormone deficiency is 0.3 mg/kg/week divided daily doses given by subcutaneous injections. Other exemplary doses in treatment of GH deficient disorders in children include 0.35 mg/kg/week for children with chronic renal insufficiency; 0.375 mg/kg/week for children with Turner's syndrome; 0.3 mg/kg/week for children with idiopathic short stature; and 0.7 mg/kg/week for children with intrauterine growth retardation (see, for example, Vance et al. *The New England Journal of Medicine* 341(6): 1206-1216 (1999)).

The starting dose of GH in adults is typically 0.01-0.03 mg/kg/wk by subcutaneous injection. The maximal daily dose for subjects up to 35 years of age is typically 0.18 mg/kg/wk and 0.09 mg/kg/wk for older subjects. In various treatment studies on growth hormone-replacement, the dose of unmodified growth hormone has ranged from about 0.04 to about 0.18 mg/kg/wk (see, Vance et al. *The New England Journal of Medicine* 341(6): 1206-1216 (1999)). Others recommend (see e.g., the Growth Hormone Research Society recommendations) a starting dose of 105-210 mg/week, regardless of body weight (see, e.g., Consensus guidelines for the diagnosis and treatment of adults with growth hormone deficiency: Summary statement of the Growth Hormone Research Society Workshop on Adults Growth Hormone Deficiency. *J. Clin. Endocrinol. Metab.* 83: 379-381 (1998)).

2. Cachexia

AIDS wasting and other forms of cachexia refer to metabolic disorders that cause the body to consume vital muscle and organ tissue (lean body mass) for energy instead of primarily relying on the body's fat supplies. People with AIDS wasting typically experience a loss of 5-10% or more of lean body mass, which includes muscle tissue, body organs, blood cells and lymphatic fluids. In spite of the anti-retroviral therapy, which extends the lives of people with HIV, AIDS wasting remains one of the principal causes of ill health in people with HIV/AIDS. Estimates of the prevalence of AIDS wasting range from 4-30% of HIV infected individuals. Studies have demonstrated that AIDS wasting, when left untreated, is directly correlated with mortality. Similar manifestations of wasting are observed in connection with other diseases, e.g., cancers.

Dosages and regimens of modified GHs provided herein can be empirically determined. Dosages for unmodified GH can be used as guidance for determining dosages for modified GH. Factors such as the level of activity and half-life of the modified GH in comparison to the unmodified GH can be used in making such determinations. The modified GHs provided herein have increased protein stability and improved half-life and in turn deliver longer lasting, more stable therapeutic effects in the treatment of AIDS wasting. Recombinant GH received approval from the US FDA in 1996 for the treatment of AIDS wasting. The recommended initial adult dosage of unmodified growth hormone therapy used in the treatment of cachexia is not more than 0.04 mg/kg/week divided into six or seven subcutaneous injections. The dose can be increased at four-to eight-week intervals according to individual subject requirements up to a maximum of 0.08 mg/kg/week, depending upon subject tolerance of treatment (see package insert for Serostim). These exemplary dosages can be used as guidance in determination of dosing regimes for modified GH polypeptides, along with additional determinations of properties and activities of modified GH compared with an unmodified form.

3. Anti-aging

Aging is associated with a decline in gonadotropins, thyroid-stimulating hormone and pituitary function; often termed "somatopause." Thus, as a pituitary hormone, GH also has been reported to decline with age beginning in the third decade (see, for example Corpas et al. *Endocr Rev* 14: 20-39 (1993)). Pathologically decreased GH is associated with many of the changes seen with aging including increasing fat, decreasing muscle mass, and decreasing bone mass. Growth hormone replacement in growth hormone-deficient older individuals can improve quality of life, enhance bone and muscle mass, and reduce cardiovascular risk.

As described herein, dosages and dosing regimens of modified GHs provided herein can be empirically determined. The initial therapeutic dose of modified GH provided herein can be determined using the guidance of the recommended initial adult dosage approved for unmodified growth hormone and then titrated according to the improved therapeutic effect resulting from the modified GH. Exemplary subcutaneous dosing of recombinant hGH therapy in elderly male subjects aged 61 to 81 can be 0.03 mg/kg of body weight, injected three times a week in the morning; the interval between injections being either one or two days (2.6 IU per milligram of hormone) (see, for example, Rudman et al. *The New England Journal of Medicine* 323(1): 1-6 (1990)). Exemplary subcutaneous dosing of recombinant hGH therapy in elderly female subjects can be 0.025 mg/kg body weight/day (Bonello et al. *J. Am. Geriatr. Soc.* 44(9): 1038-42 (1996)). These doses can be used along with comparisons of properties of the modified and unmodified GH polypeptides to determine dosages for the modified GH. For example, the modified GHs provided herein have increased protein stability and improved half-life and, in turn, deliver longer lasting, more stable anti-aging therapeutic effects.

4. Renal Osteodystrophy

Renal osteodystrophy, which includes a variety of skeletal disorders ranging from high turnover to low turnover lesions, both leading to reduced bone mineral density and higher fracture incidences, is common in subjects with chronic renal failure. Clinical trials have shown positive effects of recombinant human GH therapy as a treatment for improving bone turnover and bone mineral density in growth hormone-deficient subjects as well as subjects with chronic renal disease on hemodialysis (see, for example, Kotzmann et al. *Journal of Nephrology* 17(1): 87-94 (2004)). GH, as well as IGF-1, have marked effects on bone metabolism and bone mineral density. GH can stimulate chondrocyte growth and function as well as increase, directly or indirectly, bone turnover by stimulating osteoblasts and osteoclasts and inducing collagen synthesis, thereby enhancing long bone growth.

Dosages and dosing regimens of modified GHs provided herein can be empirically determined. The initial therapeutic dose of modified GH provided herein can be determined using the guidance of the recommended initial adult dosage approved for unmodified growth hormone and then titrated according to the improved therapeutic effect resulting from the modified GH. Exemplary dosing of adult subjects with chronic renal failure on hemodialysis can be 0.125 IU/kg (40.5 µg/kg) of GH injected subcutaneously 3 times per week after each dialysis session during the first 4 weeks of treatment and 0.25 IU/kg (81 µg/kg) thereafter. The length and dosage of GH treatment can vary according to subject tolerance (see Kotzmann et al. *Journal of Nephrology* 17(1): 87-94 (2004)). Comparisons of properties and activities of modified GH compared to unmodified GH can be used to determine alternate dosages and dosing regimes.

5. Cystic Fibrosis

Subjects, in particular children, with cystic fibrosis have problems with poor linear growth, inadequate weight gain, and protein catabolism. Multiple studies have demonstrated improved height and weight in children treated with GH. Other studies have shown that GH treatment results in improved forced vital capacity, improved exercise tolerance and bone accumulation. Still others have found GH treatment improves clinical status as measured by decreased hospitalizations and courses of intravenous antibiotics (see, for example, Hardin D. S., *Eur. J. Endocrinol.* 151(Suppl 1): S81-85 (2004)).

Dosages and dosing regimens of the modified GHs provided herein can be determined empirically. For example, guidance of dosages and dosing from unmodified GH and comparison of properties and activities of modified GH with unmodified GH can be used in the determination. Exemplary dosing of pediatric subjects with cystic fibrosis includes, but is not limited to, daily subcutaneous GH injections amounting to 0.3 mg/kg/wk (see Hardin D. S., *Eur. J. Endocrinol.* 151 (Suppl 1): S81-85 (2004)). The initial therapeutic dose of modified GH provided herein can be the recommended initial adult dose for treatments using unmodified growth hormone and thereafter titrated according to the longer lasting and improved therapeutic effects of the modified GH provided herein. The modified GHs provided herein have increased protein stability and improved half-life. Such modified GH can deliver longer lasting, more stable therapeutic effect in the treatment of subjects with cystic fibrosis and can allow for lower dosing and less frequent dosages.

6. Other Conditions

A number of other physiological or pathological conditions are potential targets for GH therapy. These physiological or pathological conditions include, but are not limited to, stress, decreased energy, decreased physical power, catabolic illnesses including, for example, those associated with respiratory failure and burn injuries (see for example, Hart et al. *Ann. Surg.* 233(6): 827-34 (2001)), recovery from surgery (see for example, Yeo et al. *Growth Horm. IGF Res.* 13(6): 361-70 (2003)), congestive cardiomyopathy (see for example, Adamapolous et al. *Eur. Heart J.* 24(24): 2186-96 (2003)), liver transplantation or liver regeneration after hepatectomy (see for example Luo et al. *World J Gastroenterol.* 10(9): 1292-6 (2004)), chronic inflammatory or nutritional disorders such as short bowel syndrome, Crohn's disease (see for example, Slonim et al. *N. Engl. J. Med.* 342(22): 1633-7 (2000)), juvenile chronic arthritis (see for example, Saha et al. *J Rheumatol.* 1(7): 1413-7 (2004)), male fertility disorders (see for example Ovesen et al. *Fertil Steril.* 66(2): 292-8 (1996)), and other disorders such as impaired immune function of HIV-infected subjects, osteoporosis, achondroplasia/hypochondroplasia, skeletal dysplasia, X-linked hypophosphatemic rickets (see for example, Seikaly et al. *Pediatrics.* 100(5): 879-84 (1997)), Noonan Syndrome (see for example, Noordam et al. *Acta Paediatr.* 90(8): 889-94 (2001)), obesity, Down's syndrome, Spina bifida, and fibromyalgia (see for example, Bennet et al. *Am. J. Med.* 104(3): 227-31 (1998)).

I. Articles of Manufacture and Kits

Modified growth hormone polypeptides and nucleic acids can be packaged as articles of manufacture containing packaging material, a modified GH polypeptide, a nucleic acid molecule encoding a modified GH or a derivative or biologically active portion thereof provided herein, which is effective for treating a growth hormone disease or disorder, and a label that indicates that modified GH polypeptide or nucleic acid molecule is used for treating a growth hormone disease or disorder.

The articles of manufacture provided herein contain packaging materials. Packaging materials for use in packaging pharmaceutical products are well known to those of skill in the art. See, e.g., U.S. Pat. Nos. 5,323,907, 5,052,558 and 5,033,352. Examples of pharmaceutical packaging materials include, but are not limited to, blister packs, bottles, tubes, inhalers, pumps, bags, vials, containers, syringes, bottles, and any packaging material suitable for a selected formulation and intended mode of administration and treatment. A wide array of formulations of the compounds and compositions provided herein are contemplated as are a variety of treatments for any GH disease or disorder.

Modified GH polypeptides and nucleic acid molecules also can be provided as kits. Kits can include a modified GH and an item for administration. For example a modified GH can be supplied with a device for administration, for example a syringe, an inhaler, or an applicator. The kit can include instructions for application including dosages, dosing regimens and instructions for modes of administration. Kits also can include a modified GH and an item for diagnosis. For example such kits can include an item for measuring the concentration, amount or activity of growth hormone or a growth hormone regulated system of a subject.

The following examples are included for illustrative purposes only and are not intended to limit the scope of the invention.

J. Examples

Example 1

Cloning cDNA Encoding a GH in pNAUT, a Mammalian Cell Expression Plasmid

Nucleic acid molecules encoding GH protein (see, SEQ ID NO:1) were cloned into a mammalian expression vector, prior to the generation of the selected mutations. A collection of pre-designed, targeted mutants was then generated such that each individual mutant was created and processed individually, physically separated from each other and in addressable arrays.

The hGH-cDNA was obtained by synthesis in vitro from human pituitary gland mRNA (Clontech) using SMART kit (Clontech). First, hGH-encoding cDNA was cloned by PCR amplification using the primers: forward GH1 (SEQ ID NO:702) and reverse GH1 REV (SEQ ID NO:703). The PCR amplified product was cloned into an *E. coli* vector (pTOPO-TA) to produce the plasmid designated pTOPO-hGH4 (SEQ ID NO:717).

The sequence of the hGH-encoding cDNA was confirmed by sequencing. The sequenced cDNA was amplified using the primers HGHFORHIND (SEQ TD NO:704) and HGHREV (SEQ ID NO:705), which generated HindIII and XbaI restriction sites on either end of the clone. After restriction with HindIII and XbaI., the PCR fragment containing the hGH-encoding cDNA was subcloned into the corresponding sites in pUC-CMVhGHpA to produce pNAUT-hGH (SEQ ID NO:716).

To express hGH, the hGH encoding cDNA fragment was amplified by PCR using the primers hGHFORPET (SEQ ID NO:706) and hGHREVPET (SEQ ID NO:707), using Herculase® (Invitrogen) DNA-polymerase. The primers generate the restriction sites NdeI and BamHI forward and reverse respectively. The forward primer also was designed to change Proline 2 and Proline 5 codons from human to *E. coli* (CCA to CCG and CCC to CCG) and the reverse to change the STOP codon (TAG to TAA) in order to optimize the *E. coli* production yield. The PCR fragment was subcloned into pET-24 (Invitrogen; SEQ ID NO: 718). In order to optimize the hGH yield in *E. coli*, additional changes were made in the hGH sequence. Cycles of mutagenesis were used to change Arg 8 and Arg 16 codons from human to bacteria, using the primers: hGHARG8FOR (SEQ ID NO:708) and hGHARG8REV (SEQ ID NO: 709) and hGHARG16FOR (SEQ ID NO:710) and hGHARG16REV (SEQ ID NO:711) respectively. The resulting construct was verified by sequencing. The final plasmid was designated pET-24Naut-hGH (see SEQ ID No. 718).

Example 2

Design of GH Variants by 2D-scanning 2D-scanning technology, described herein and also described in published Application No. US-2004-0132977-A1 and U.S. application Ser. No. 10/658,355) was used to design and obtain hGH mutants with improved resistance to proteolysis and/or improved thermal tolerance. Is-HITs were identified based upon (1) protein property to be evolved (i.e., resistance to proteolysis or thermal tolerance); (2) amino acid sequence; and (3) properties of individual amino acids.

a. LEADS Created for Higher Resistance to Proteolysis of hGH

Variants were designed using 2D-scanning. Positions selected (is-HITs) on pituitary hGH (SEQ ID NO:1) were (numbering corresponds to amino acid positions in the mature protein): F1, P2, P5, L6, R8, L9, F10, D11, L15, R16, R19, L20, L23, F25, D26, Y28, E30, F31, E32, E33, Y35, P37, K38, E39, K41, Y42, F44, L45, P48, L52, F54, E56, P59, P61, R64, E65, E66, K70, L73, E74, L75, L76, R77, L80, L81, L82, W86, L87, E88, P89, F92, L93, R94, F97, L107, Y103, D107, Y111, D112, L113, L114, K115, D116, L117, E118, E119, L124, M125, R127, L128, E129, D130, P133, R134, F139, K140, Y143, K145, F146, D147, D153, D154, L156, K158, Y160, L162, L163, Y164, F166, R167, K168, D169, M170, D171, K172, E174, F176, L177, R178, R183, E186, and F191. The native amino acidn at each of the is-HIT positions listed above and shown in FIG. 1 was replaced by residues defined by the susbtitution matrix PAM250 (FIG. 2). The actual residue substitutions performed are listed in Table 3. A total of 222 variants of hGH were generated. See Table 4 and SEQ ID NOS: 2-223.

TABLE 3

| Amino acid at is-HIT | Replacing amino acids |
| --- | --- |
| R | H, Q |
| E | H, Q, N |
| K | Q, N |
| D | N, Q |
| M | I, V |
| P | A, S |
| Y | I, H |
| F | I, V |
| W | H, S |
| L | I, V |

Amino acids at is-HITs (left column of Table 3) where replaced by selected replacing amino acids (right column of Table 3) to produce GH variants with increased resistance to proteolysis.

TABLE 4

List of hGH variants for increased resistance to proteolysis

| F1I/P2A | F1I/P2S | F1V/P2A | F1V/P2S | P5A | P5S | L6I | L6V |
| --- | --- | --- | --- | --- | --- | --- | --- |
| R8H | R8Q | L9I | L9V | F10I | F10V | D11N | D11Q |
| M14I | M14V | L15I | L15V | R16H | R16Q | R19H | R19Q |
| L20I | L20V | L23I | L23V | F25I | F25V | D26N | D26Q |
| Y28H | Y28I | E30Q | E30H | E30N | F31I | F31V | E32Q |
| E32H | E32N | E33Q | E33H | E33N | Y35H | Y35I | P37A |
| P37S | K38N | K38Q | E39Q | E39H | E39N | K41N | K41Q |
| Y42H | Y42I | F44I | F44V | L45I | L45V | P48A | P48S |
| L52I | L52V | F54I | F54V | E56Q | E56H | E56N | P59A |
| P59S | P61A | P61S | R64H | R64Q | E65Q | E65H | E65N |
| E66Q | E66H | E66N | K70N | K70Q | L73I | L73V | E74Q |
| E74H | E74N | L75I | L75V | L76I | L76V | R77H | R77Q |
| L80I | L80V | L81I | L81V | L82I | L82V | W86H | W86S |
| L87I | L87V | E88Q | E88H | E88N | P89A | P89S | F92I |
| F92V | L93I | L93V | R94H | R94Q | F97I | F97V | L101I |
| L101V | Y103H | Y103I | D107N | D107Q | Y111H | Y111I | D112N |
| D112Q | L113I | L113V | L114I | L114V | K115N | K115Q | D116N |
| D116Q | L117I | L117V | E118Q | E118H | E118N | E119Q | E119H |
| E119N | L124I | L124V | M125I | M125V | R127H | R127Q | L128I |
| L128V | E129Q | E129H | E129N | D130N | D130Q | P133A | P133S |
| R134H | R134Q | F139I | F139V | K140N | K140Q | Y143H | Y143I |
| K145N | K145Q | F146I | F146V | D147N | D147Q | D153N | D153Q |
| D154N | D154Q | L156I | L156V | L157I | L157V | K158N | K158Q |
| Y160H | Y160I | L162I | L162V | L163I | L163V | Y164H | Y164I |
| F166I | F166V | R167H | R167Q | K168N | K168Q | D169N | D169Q |
| M170I | M170V | D171N | D171Q | K172N | K172Q | E174Q | E174H |
| E174N | F176I | F176V | L177I | L177V | R178H | R178Q | R183H |
| R183Q | E186Q | E186H | E186N | F191I | F191V | | | b. LEADS Created for Higher Thermal Tolerance of hGH

Table 5 shows the list of is-HITs for increased thermal tolerance identified on hGH using 2D-scanning. 16 positions (is-HITs) were identified whose numbering corresponds to that in the mature protein. Once the is-HIT target positions were selected, replacing amino acids for each is-HIT target position were identified. Appropriate replacement amino acids, specific for each is-HIT, were generated to maintain or improve the requisite activity of the protein (i.e., GH activity) and increase protein stability.

Mutagenesis was performed by replacing single amino acid residues at specific is-HIT target positions one-by-one. Each mutant generated was the single product of an individual mutagenesis reaction. Substituted amino acids were compatible with protein structure and function. To select the candidate replacement amino acids for each is-HIT position, amino acid substitution matrices were used. The native amino acid at each of the is-HIT positions shown in Table 5 was replaced by residues increasing polar interaction with other amino acids: E, D, K, R, N, Q, S, and T. A total of 128 variants of hGH were generated. (See Table 6 and SEQ ID NOS: 224-351).

The is-HIT positions identified in helices A and C of hGH (SEQ ID NO:1) in order to increase thermal tolerance are L6, L9, A13, L15, A17, L20, L23, A24, A105, V110, L113, L114, L117, I121, L124, L128 (see Table 5). Specific amino acids (including as an example glutamic acid (E), aspartic acid (D), lysine (K) and arginine (R)) were chosen as amino acids to replace the amino acids at each is-HIT position and thus introduce additional inter-helix bonds into the region of helices A and C (see Table 6).

TABLE 5

List of is-HITs for increased thermal tolerance of hGH.

| | |
|---|---|
| L6 | L9 |
| A13 | L15 |
| A17 | L20 |
| L23 | A24 |
| A105 | V110 |
| L113 | L114 |
| L117 | I121 |
| L124 | L128 | described below. Mutagenesis reactions were performed with Quickchange® kit (Invitrogen) using pNaut-hGH (SEQ ID NO: 716) as the template. Each individual mutagenesis reaction contains a pair of mutagenic primers (sense and antisense) (SEQ ID NOS: 352-701). For each reaction, 10 picomoles of each sense mutagenic primer was mixed with 30 ng template, 10 picomoles of antisense mutagenic primer, and 1.25 U of Pfu turbo polymerase (Invitrogen). To allow DNA annealing, PCR plates were incubated at 95° C. for 30 seconds. Elongation and ligation reactions were done in 14 cycles of 95° C. for 30 seconds, 50° C. for 1 minute and 68° C. for 8 minutes. To eliminate the parental plasmid, a restriction with 5 U of DpnI (BioLabs) was performed. Transformation of competent cells was accomplished by 20 µl of competent cells (HT-96, Novagen) and 1 ng of plasmid DNA. Plasmid DNA isolation was performed by Nucleobond® 96 turbo Minipreps kit (Macherey-Nagel). Selection of mutated plasmids was performed by ampicillin 100 µg/ml. Transformants were selected by ampicillin eukaryotic expression plasmid and kanamycin for prokaryotic expression plasmid. Each mutation that was introduced to produce this collection of candidate LEAD hGH mutant plasmids encoding proteins

TABLE 6

List of hGH mutants for increased thermal tolerance

| | | | | | | | |
|---|---|---|---|---|---|---|---|
| L6E | L6D | L6K | L6R | L6N | L6Q | L6S | L6T |
| L9E | L9D | L9K | L9R | L9N | L9Q | L9S | L9T |
| A13E | A13D | A13K | A13R | A13N | A13Q | A13S | A13T |
| L15E | L15D | L15K | L15R | L15N | L15Q | L15S | L15T |
| A17E | A17D | A17K | A17R | A17N | A17Q | A17S | A17T |
| L20E | L20D | L20K | L20R | L20N | L20Q | L20S | L20T |
| L23E | L23D | L23K | L23R | L23N | L23Q | L23S | L23T |
| A24E | A24D | A24K | A24R | A24N | A24Q | A24S | A24T |
| A105E | A105D | A105K | A105R | A105N | A105Q | A105S | A105T |
| V110E | V110D | V110K | V110R | V110N | V110Q | V110S | V110T |
| L113E | L113D | L113K | L113R | L113N | L113Q | L113S | L113T |
| L114E | L114D | L114K | L114R | L114N | L114Q | L114S | L114T |
| L117E | L117D | L117K | L117R | L117N | L117Q | L117S | L117T |
| I121E | I121D | I121K | I121R | I121N | I121Q | I121S | I121T |
| L124E | L124D | L124K | L124R | L124N | L124Q | L124S | L124T |
| L128E | L128D | L128K | L128R | L128N | L128Q | L128S | L128T |

Example 3

Mutagenesis

A series of mutagenic primers were designed to generate the appropriate site-specific mutations in the hGH cDNA as was confirmed by sequencing. Lead mutants of hGH were first generated in the pNaut-hGH plasmid. Mutants were re-generated in prokaryotic expression plasmid (pET-hGH) using the corresponding primers (SEQ ID NOS: 352-701). The presence of the mutation was verified by sequencing.

TABLE 7

Mutants generated

| | | | | | | | |
|---|---|---|---|---|---|---|---|
| F1I/P2A | F25I | Y42H | K70Q | F92V | E118H | K145N | K168N |
| F1I/P2S | F25V | Y42I | L73I | L93I | E118N | K145Q | K168Q |
| F1V/P2A | D26N | F44I | L73V | L93V | E119Q | F146I | D169N |
| F1V/P2S | D26Q | F44V | E74Q | R94H | E119H | F146V | D169Q |
| P5A | Y28H | L45I | E74H | R94Q | E119N | D147N | M170I |
| P5S | 72 8I | L45V | E74N | F97I | L124I | D147Q | M170V |
| L6I | E30Q | P48A | L75I | F97V | L124V | D153N | D171N |
| L6V | E30H | P48S | L75V | L101I | M125I | D153Q | D171Q |
| R8H | E30N | L52I | L76I | L101V | M125V | D154N | K172N |
| R8Q | F31I | L52V | L76V | Y103H | R127H | D154Q | K172Q |
| L9I | F31V | F54I | R77H | Y103V | R127Q | L156I | E174Q |
| L9V | E32Q | F54V | R77Q | D107N | L128I | L156V | E174H |

TABLE 7-continued

| Mutants generated | | | | | | | |
|---|---|---|---|---|---|---|---|
| F10I | E32H | E56Q | L80I | D107Q | L128V | L157I | E174N |
| F10V | E32N | E56H | L80V | Y111H | E129Q | L157V | F176I |
| D11N | E33Q | E56N | L81I | Y111I | E129N | K158N | F176V |
| D11Q | E33H | P59A | L81V | D112N | D130N | K158Q | L177I |
| M14I | E33N | P59S | L82I | D112Q | D130Q | Y160H | L177V |
| M14V | Y35H | P61A | L82V | L113I | P133A | Y160I | R178H |
| L15I | Y35I | P61S | W86H | L113V | P133S | L162I | R178Q |
| L15V | P37A | R64H | W86S | L114I | R134H | L162V | R183H |
| R16H | P37S | R64Q | L87I | L114V | R134Q | L163I | R183Q |
| R16Q | K38N | E65Q | L87V | K115N | R134Q | L163V | E186Q |
| R19H | K38Q | E65H | E88Q | K115Q | F139I | Y164H | E186H |
| R19Q | E39Q | E65N | E88H | D116N | F139V | Y164I | E186N |
| L20I | E39H | E66Q | E88N | D116Q | K140N | F166I | F191I |
| L20V | E39N | E66H | P89A | L117I | K140Q | F166V | F191V |
| L23I | K41N | E66N | P89S | L117V | Y143H | R167H | |
| L23V | K41Q | K70N | F92I | E118Q | Y143I | R167Q | |

Example 4

Production of Native and Modified hGH Polypeptides in Mammalian Cells

HEK 293 EBNA cells (available for example, from Roche; see also, Kruyt et al. *Blood* 90: 3288-3295 (1997)) were cultured in Dulbecco's MEM-GlutamaxI-sodium pyruvate medium supplemented with 10% SVF and geneticin. Cells were grown at 37° C. in an atmosphere of 7% $CO_2$. Production of either native or mutant hGH was performed by transient transfection. Cells were seeded in 6-well plates at $5 \times 10^5$ cells/well in DMEM supplement with 1% of SVF; after 40 hours cells were transfected using PEI (25 KDa; Sigma-Aldrich) in 2 wells per protein; 2 wells were mock transfected to have a negative control for the ELISA and for determination of activity. After 24 hours, the supernatants were harvested, the samples aliquoted in 96-well plates and stored at −20° C. for standardization by ELISA (hGH ELISA, Roche) or for screening.

Example 5

Analysis of the Activity of the Modified hGH Mutant Polypeptides

For a primary screening, each mutant was tested individually for at least two criteria in parallel: (i) hGH activity (in a cell-based assay in vitro, see below); (ii) resistance to proteolysis; (iii) thermal tolerance. For all tests, serial dilution curves were produced and '$EC_{50}$' figures obtained for each individual mutant. Native hGH (SEQ ID NO:1) was produced and treated using the same protocols as for hGH mutants was used throughout the entire process as a reference standard. An international hGH standard obtained from NIBSC, UK was also used as a second reference standard. All treatments and testing were done in triplicate.

a. Cell Proliferation Assay

Standard GH activity in vitro was measured for each mutant and compared with native hGH (SEQ ID NO:1) in a cell proliferation activity on Nb2-11C cells (rat lymphoma cell line). Dose (concentration)-response (activity) experiments for cell proliferation activity allowed for the calculation of the "potency" of activity, or $EC_{50}$ for each mutant. Cell proliferation activity in the same system was measured after incubation with proteolytic samples such as specific proteases, mixtures of selected proteases, human serum or human blood. Assessment of activity following incubation with proteolytic samples allowed for the determination of the residual cell proliferation activity and the respective kinetics of half-life upon exposure to proteases.

The activity remaining after exposure to proteases was measured by a proliferation cell assay using Nb2-11 cells (rat lymphoblast). Nb2-11 cells were cultured in Fisher medium supplemented with 10% of SVF and 10% of equine serum (ES). 24 hours before the proliferation assay, the cells were centrifuged and washed with PBS. The cells were then cultured in Fisher medium supplemented only with 10% of ES at a density of $0.5$-$0.8 \times 10^6$ cells/ml. After 24 hours of culture the cells were seeded in 96 well plates at $4 \times 10^4$ cells/well and treated with three fold serial dilution (12 points) of pre-treated native hGH or mutants between 6000 pg/ml and 0.3 pg/ml in triplicates. NIBSC hGH was used as an internal control for each proliferation assay.

After 48 hours of treatment with either native or mutant hGH (pre-treated with proteases) the proliferation of Nb2-11 cells was measured. 20 µl of Cell Titer 96 AQ (Promega) per well was added and cells incubated for 1 hour at 37° C. The assay measures the conversion of the tetrazolium MTS into a soluble formazan. Samples were read in a Spectramax reader (Molecular Device) at 490 nm.

b. Proteolysis Resistance Assay

Following determination by ELISA of the amount of hGH produced (for native as well as for each mutant hGH); up to 150 µl of supernatant containing 15 ng of native hGH or variants were treated with a mixture of proteases at 1% w/w of total proteins in the supernatant (1% serum, as the concentration of total protein in 1% of serum is 600 µg/ml, the 1% of proteases was based on the total amount of proteins and not only in the amount of hGH). hGH Mutants were treated with proteases in order to identify resistant molecules. The relative resistance of the mutant hGH molecules compared to native hGH was determined by exposure (120 min, 25° C.) to a mixture of proteases (containing 1.5 pg of each of the following proteases (1% wt/wt, Sigma): α-chymotrypsin, carboxypeptidase, endoproteinase Arg-C, endoproteinase Asp-N, endoproteinase Glu-C, endoproteinase Lys-C, and trypsin). At the end of the incubation time, 10 µl of anti-protease complete medium containing mini EDTA free tablets (Roche) diluted 1/1000 in 10 ml DMEM was added to each reaction in order to inhibit protease activity. Treated samples were then used to determine residual activities.

The percent of residual hGH activity over time of exposure to proteases was evaluated by a kinetic study using 1.5 pg of protease mixture. The mixture of proteases was freshly prepared for each new assay from stock solutions of endoproteinase Glu-C (SIGMA) 200 µg/ml; trypsin (SIGMA) 400 µg/ml and α-chymotrypsin (SIGMA) 400 µg/ml. Incubation times were (in hours): 0, 0.08, 0.25, 0.5, 0.75, 1, 2, 4, 6 and 8. Briefly, 20 µl of each proteolytic sample (proteases, serum, blood) was added to 100 µl of hGH at 400 pg/ml and 800 pg/ml and incubated for variable times, as indicated. At the appropriate time-points, 10 µl of anti-proteases mixture, complete mini EDTA-free protease inhibitor cocktail (Roche; one tablet dissolved in 10 ml of DMEM and then diluted 1/500) was added to each well in order to stop proteolysis reactions. Activity assays were then performed as described for each sample in order to determine the residual activity at each time-point.

c. Thermal Tolerance Assay

To assess the kinetics of thermal tolerance, individual hGH variants are tested with increasing time-points of increased temperature incubation. After determination by ELISA of the amount of proteins produced (for each individual hGH variant and for native hGH), 0.4 ng of native hGH or modified hGH is added to 250 µl of DMEM serum free medium supplemented with 1× anti-protease cocktail mixture (mini EDTA free, Roche) and incubated at 37° C. in a deep-well plate.

At increasing time-points (0, 2, 4, 6, 8, 12, 24, 36, 48 hours), 380 µl of DMEM medium supplemented with 5% SVF is added to 20 µl aliquots (final concentration 12000 pg/ml of hGH). Samples are immediately frozen and stored at −20° C.

For each molecule (whether native hGH or mutant hGHs), the residual activity (cell proliferation assay on NB2-11C cells; see above) at each time-point of incubation at 37° C. is determined.

Example 6

Evaluation of GH Variants

Various biological activities, including protease resistance and potency of each individual mutant were analyzed using a mathematical model and algorithm (NautScan; Fr. Patent No. 9915884; see, also published International PCT application No. WO 01/44809 based on PCT No. PCT/FR00/03503; and described above).

Data was processed using a Hill equation-based model that uses key feature indicators of the performance of each individual mutant. Briefly, the Hill equation is a mathematical model that relates the concentration of a drug (i.e., test compound or substance) to the response measured.

$$y = \frac{y_{max}[D]^x}{[D]^n + [D_{50}]^n}$$

y is the variable measured, such as a response, signal, $y_{max}$ is the maximal response achievable, [D] is the molar concentration of a drug (e.g., the GH or modified GH), [$D_{50}$] is the concentration that produces a 50% maximal response to the drug, n is the slope parameter, which is 1 if the drug binds to a single site and with no cooperativity between or among sites. A Hill plot is $\log_{10}$ of the ratio of ligand-occupied receptor to free receptor vs. log [D] (M). The slope is n, where a slope of greater than 1 indicates cooperativity among binding sites, and a slope of less than 1 can indicate heterogeneity of binding. This equation has been employed in methods for assessing interactions in complex biological systems, the parameters, $\pi$, $\kappa$, $\tau$, $\epsilon$, $\eta$, $\theta$, are as follows:

$\pi$ is the potency of the biological agent acting on the assay (cell-based) system;

$\kappa$ is the constant of resistance of the assay system to elicit a response to a biological agent;

$\epsilon$ is the slope at the inflexion point of the Hill curve (or, in general, of any other sigmoidal or linear approximation), to assess the efficiency of the global reaction (the biological agent and the assay system taken together) to elicit the biological or pharmacological response.

$\tau$ is used to measure the limiting dilution or the apparent titer of the biological agent.

$\theta$ is used to measure the absolute limiting dilution or titer of the biological agent.

$\eta$ is the heterogeneity of the biological process or reaction. $\eta$ measures the existence of discontinuous phases along the global reaction, which is reflected by an abrupt change in the value of the Hill coefficient or in the constant of resistance.

Modified GH polypeptides were ranked based on the values of their individual performance, as assessed by $EC_{50}$. The biological specific activity (i.e., activity per unit of protein mass; units/mg protein) was determined for each mutant using serial dilutions of the mutant in a cell-based proliferation assay (see Example 5). Twelve dilutions were made for each curve and each dilution was assayed in triplicate. Using the data from the serial dilution assays, the concentration needed to achieve 50% activity. ($EC_{50}$) was obtained. Experimental points were fitted to a sigmoidal curve using Gnuplot 5.0 (software for drawing data curves; available online at gnuplot.info) integrated to the NEMO (Newly evolved Molecules) software (Nautilus Biotech) as follows. The equation used for the sigmoidal curve fitting was:

$$Sig(x) = base + pmax*(x \exp. nu)/X \exp. nu) + kappa$$

where base, pmax, nu and kappa are parameters for each curve as follows: base=0.1, pmax=1, kappa=5000, nu=2.5 and n between 5 and 150. Gnuplot iterates fitting "n" times until it finds the best curve that fits the experimental data while minimizing the sum of the squares of the distance between each experimental point and the theoretical point on the fitting curve. Once the fitting curve for each mutant is obtained, the corresponding $EC_{50}$ and specific activity are calculated from the curves. Exemplary curves are shown in FIG. 3.

Those on the top of the ranking list were selected as LEADs. Table 8 provides activity ($EC_{50}$) and resistance to proteolysis (indicated as 'no change', 'increase' or 'decrease') data compared to native hGH (SEQ ID NO: 1 and the NIBSC GH standard described herein) for all candidate LEAD mutants described. $EC_{50}$ calculations were based on the average of two determinations. The EC50 of the modified hGH proteins was decreased, overall, compared to wild-type hGH polypeptides.

TABLE 8

| | Average of 3 determinations | |
| --- | --- | --- |
| Mutation | $EC_{50}$ | Resistance to proteolysis |
| F1I/P2A | 90.56 | increase |
| F1I/P2S | 120.67 | no changes |
| F1V/P2A | 75.28 | no changes |
| F1V/P2S | 60.39 | no changes |
| P5A | 83.66 | no changes |
| P5S | 99.51 | increase |

TABLE 8-continued

Average of 3 determinations

| Mutation | EC$_{50}$ | Resistance to proteolysis |
|---|---|---|
| L6I | 92.29 | no changes |
| L6V | 111.32 | no changes |
| R8H | 85.11 | no changes |
| R8Q | 108.30 | no changes |
| L9I | 93.41 | no changes |
| L9V | 119.78 | increase |
| F10I | 119.48 | no changes |
| F10V | 100.49 | no changes |
| D11N | 100.47 | increase |
| D11Q | 72.23 | no changes |
| M14I | 103.28 | no changes |
| M14V | 81.47 | increase |
| L15I | 76.31 | no changes |
| L15V | 2,701.08 | no changes |
| R16H | 96.75 | increase |
| R16Q | 104.24 | no changes |
| R19H | 59.89 | no changes |
| R19Q | 129.68 | no changes |
| L20I | 91.80 | no changes |
| L20V | 105.58 | no changes |
| L23I | 95.68 | increase |
| L23V | 95.33 | increase |
| F25I | 75.71 | no changes |
| F25V | 61.20 | no changes |
| D26N | 77.15 | increase |
| D26Q | 84.56 | no changes |
| Y28H | 125.40 | no changes |
| Y28I | 100.63 | no changes |
| E30Q | 67.36 | no changes |
| E30H | 64.49 | no changes |
| E30N | 61.53 | no changes |
| F31I | 146.71 | no changes |
| F31V | 103.13 | no changes |
| E32Q | 71.39 | no changes |
| E32H | 50.23 | no changes |
| E32N | 70.15 | no changes |
| E33Q | 77.59 | no changes |
| E33H | 83.78 | no changes |
| E33N | 75.98 | no changes |
| Y35H | 104.16 | no changes |
| Y35I | 93.11 | no changes |
| P37A | 113.48 | no changes |
| P37S | 71.11 | no changes |
| K38N | 121.66 | increase |
| K38Q | 127.34 | no changes |
| E39Q | 78.13 | no changes |
| E39H | 73.37 | no changes |
| E39N | 94.38 | no changes |
| K41N | 177.74 | no changes |
| K41Q | 237.04 | increase |
| Y42H | 146.32 | increase |
| Y42I | 244.83 | increase |
| F44I | 140.34 | no changes |
| F44V | 221.00 | no changes |
| L45I | 110.10 | no changes |
| L45V | 164.03 | no changes |
| P48A | 110.11 | no changes |
| P48S | 90.70 | no changes |
| L52I | 78.15 | no changes |
| L52V | 78.87 | no changes |
| F54I | 93.14 | no changes |
| F54V | 87.81 | no changes |
| E56Q | 87.23 | increase |
| E56H | 100.61 | no changes |
| E56N | 70.11 | increase |
| P59A | 101.11 | no changes |
| P59S | 94.22 | no changes |
| P61A | 99.87 | no changes |
| P61S | 134.30 | no changes |
| R64H | 98.68 | no changes |
| R64Q | 116.96 | no changes |
| E65Q | 61.83 | increase |
| E65H | 106.92 | no changes |
| E65N | 142.94 | no changes |
| E66Q | 81.38 | increase |
| E66H | 72.06 | no changes |
| E66N | 142.65 | no changes |
| K70N | 107.42 | no changes |
| K70Q | 94.00 | no changes |
| L73I | 80.51 | no changes |
| L73V | 110.40 | increase |
| E74Q | 112.51 | no changes |
| E74H | 120.05 | no changes |
| E74N | 143.00 | increase |
| L75I | 114.32 | no changes |
| L75V | 114.22 | no changes |
| L76I | 92.75 | no changes |
| L76V | 128.45 | no changes |
| R77H | 199.12 | no changes |
| R77Q | 77.86 | no changes |
| L80I | 110.78 | no changes |
| L80V | 80.57 | no changes |
| L81I | 175.02 | no changes |
| L81V | 132.13 | increase |
| L82I | 111.14 | no changes |
| L82V | 80.58 | no changes |
| W86H | 70.90 | no changes |
| W86S | 100.31 | no changes |
| L87I | 226.80 | no changes |
| L87V | 89.48 | increase |
| E88Q | 61.89 | no changes |
| E88H | 401.37 | no changes |
| E88N | 100.23 | no changes |
| P89A | 113.76 | no changes |
| P89S | 89.65 | no changes |
| F92I | 101.81 | no changes |
| F92V | 97.72 | no changes |
| L93I | 76.97 | no changes |
| L93V | 96.40 | no changes |
| R94H | 88.74 | no changes |
| R94Q | 94.03 | no changes |
| F97I | 93.38 | no changes |
| F97V | 68.32 | no changes |
| L101I | 94.59 | no changes |
| L101V | 134.99 | increase |
| Y103H | 83.33 | no changes |
| Y103I | 88.96 | no changes |
| D107N | 87.43 | no changes |
| D107Q | 70.59 | no changes |
| Y111H | 58.16 | no changes |
| Y111I | 56.19 | increase |
| D112N | 73.94 | increase |
| D112Q | 72.75 | no changes |
| L113I | 83.87 | no changes |
| L113V | 82.49 | no changes |
| L114I | 60.48 | no changes |
| L114V | 81.81 | no changes |
| K115N | 97.38 | no changes |
| K115Q | 89.44 | no changes |
| D116N | 75.90 | no changes |
| D116Q | 99.39 | increase |
| L117I | 126.24 | no changes |
| L117V | 111.76 | no changes |
| E118Q | 93.67 | no changes |
| E118H | 101.91 | no changes |
| E118N | 83.61 | no changes |
| E119Q | 110.30 | increase |
| E119H | 79.50 | no changes |
| E119N | 73.04 | no changes |
| L124I | 99.38 | no changes |
| L124V | 103.17 | increase |
| M125I | 97.04 | increase |
| M125V | 112.09 | increase |
| R127H | 88.81 | no changes |
| R127Q | 72.34 | no changes |
| L128I | 137.41 | no changes |
| L128V | 86.77 | no changes |
| E129Q | 96.71 | no changes |

TABLE 8-continued

| | Average of 3 determinations | |
|---|---|---|
| Mutation | $EC_{50}$ | Resistance to proteolysis |
| E129H | 114.09 | no changes |
| E129N | 77.15 | no changes |
| D130N | 107.61 | no changes |
| D130Q | 176.58 | no changes |
| P133A | 102.73 | increase |
| P133S | 123.01 | no changes |
| R134H | 93.22 | increase |
| R134Q | 76.53 | no changes |
| F139I | 89.02 | no changes |
| F139V | 95.71 | no changes |
| K140N | 92.18 | increase |
| K140Q | 69.56 | no changes |
| Y143H | 68.,24 | no changes |
| Y143I | 71.15 | no changes |
| K145N | 81.32 | no changes |
| K145Q | 109.72 | no changes |
| F146I | 90.18 | no changes |
| F146V | 105.26 | no changes |
| D147N | 143.77 | increase |
| D147Q | 61.81 | increase |
| D153N | 62.48 | increase |
| D153Q | 101.35 | no changes |
| D154N | 89.30 | no changes |
| D154Q | 74.20 | no changes |
| L156I | 116.04 | increase |
| L156V | 116.93 | no changes |
| L157I | 83.02 | increase |
| L157V | 79.94 | no changes |
| K158N | 186.86 | increase |
| K158Q | 100.86 | no changes |
| Y160H | 111.76 | no changes |
| Y160I | 111.35 | no changes |
| L162I | 80.80 | increase |
| L162V | 94.70 | no changes |
| L163I | 96.11 | no changes |
| L163V | 75.72 | no changes |
| Y164H | 94.71 | no changes |
| Y164I | 95.73 | no changes |
| F166I | 105.21 | increase |
| F166V | 72.90 | no changes |
| R167H | 189.52 | increase |
| R167Q | 283.50 | increase |
| K168N | 139.82 | increase |
| K168Q | 126.42 | increase |
| D169N | 48.74 | no changes |
| D169Q | 105.62 | increase |
| M170I | 89.01 | no changes |
| M170V | 78.96 | no changes |
| D171N | 80.78 | increase |
| D171Q | 84.85 | increase |
| K172N | 712.32 | no changes |
| K172Q | 127.47 | increase |
| E174Q | 62.40 | increase |
| E174H | 75.14 | increase |
| E174N | 78.32 | increase |
| F176I | 146.43 | no changes |
| F176V | 110.75 | no changes |
| L177I | 126.12 | increase |
| L177V | 102.88 | increase |
| R178H | 77.96 | no changes |
| R178Q | 119.45 | increase |
| R183H | 134.43 | no changes |
| R183Q | 82.50 | no changes |
| E186Q | 76.54 | no changes |
| E186H | 88.28 | no changes |
| E186N | 110.73 | no changes |
| F191I | 125.72 | increase |
| F191V | 115.73 | no changes |
| hGH WT | 125.69 | |
| hGH NIBSC | 135.20 | |

Example 7

Human Growth Hormone Pharmacokinetic Study in Rats a. Preparation of hGH Polypeptides a.1 Cell Culture

*Escherichia coli* strain BLR is a recA⁻ derivative of BL21 that improves plasmid monomer yields and can help stabilize target plasmids containing repetitive sequences. (Novagen).

a.2 Vector: Modified pET-24a

The pET-24a(+) vector (Novagen) carries an N-terminal T7-Tag® sequence, an optional C-terminal His-Tag® sequence and the selectable marker, kanamycin. The hGH cDNA sequence was introduced in the sites NdeI/BamHI . . . The His-Tag® and the F1 replication origin have been removed from this vector. *E. coli* strain BLR (Novagen) was transformed with the pET24Naut-hGH vector (SEQ ID NO: 719) and cultured in 4% LB broth (LB-Broth Powder, Gibco) at 37° C. with 30 µg/ml kanamycin (Sigma).

a.3 Over-expression Induction

After overnight culture, the bacteria were diluted to $OD_{600}$ 0.07 and grown to $OD_{600}$ 0.6 (estimated $8.7 \times 10^6$ cells/mL). Over-expression of the hGH cDNA sequence was initiated by adding 0.5M IPTG (Amersham) for 3 hours (the estimated doubling time was 45 min). The final $OD_{600}$ was between 1.8 to 2.2 (SOP-PRD-001/02) and production was estimated to be around 30 to 40 mg/L.

a.4 Cell Removal, Separation and Disruption

The hGH protein was found in inclusion bodies due to the over-expression in *E. coli* and the nature of the protein (large hydrophobic area). The inclusion bodies were released from the cells by bacterial lysis with lysozyme (Boehringer Mannheim, Ref. 837059), 10 mM $CaCl_2$ (Calcium Chloride Dihydrate Sigma Ultra) and 1 U/ml DNase I (DNaseI, RNase free, 10 U/µl, Roche). The inclusion bodies were harvested by centrifugation at 10,000 g for 15 min for a step yield of 90% and an estimated purity of >60%. Purity was estimated by a combination of blue coomassie stained SDS-PAGE and hGH ELISA kit (hGH Elisa kit, Roche). Lipid contamination of inclusion bodies was addressed using standard procedures of washing twice with Triton X-100 0.5% (Carlo Erba) and followed by washing twice with glycerol 5% (Sigma Ref, G-5150). Step yield was 90% with a purity of approximately >70%.

a.5 Product Solubilization and Refolding

The denaturation process was conducted with a 5:1 volume with 6M guanidinium chloride for 30 min followed by refolding by dilution to 50:1 volume equivalent with Tris 50 mM pH 8, EDTA 10 mM, L-Arg 0.2 M (Sigma) and 5% Glycerol. The guanidium chloride excess was removed by a first dialysis in the same buffer overnight in a 20× volume ratio followed by a second dialysis in a Tris pH 8 10 mM buffer in a 80× ratio volume (repeated twice). The step yield was 80% with an estimated purity of 95%.

a.6 Chromatography

Chromatography was conducted by an Anion Exchange Column (IEC) Q-sepharose FF 20 mL (Amersham) at 120 cm/hr flow rate, in 50 mM Tris (pH 8) equilibration/load conditions, at 4° C., followed by elution in 50 mM Tris (pH 8) and 200 mM NaCl. The step yield was 80% with an estimated purity of >90%. Affinity Pak Detoxy-Gel Endotoxin Removing Gel (Pierce, Prod # 20344) was used to reach a tolerable endotoxin level.

b. In Vivo Studies

The pharmacokinetic profiles of hGH mutant and native hGH proteins were tested in male Sprague-Dawley rats (6 rats/molecule). The Leads tested were: F1I/P2A, D11N, M14V, R16H, L23I, L23V, K41Q, Y42H, Y42I, L81V, L101V, D116Q, E119Q, M125I, M125V, K140N, E174N, L177I, R178Q and F191I compared to wild-type. Administration was made by subcutaneous (SC) injection at 2 mg hGH per kg weight of the rat. Blood samples were taken from the tail at increasing time points between 15 minutes (min) and 96 hours (hrs), and collected on Whatman No. 2 paper in dot blots. Elution of the hGH proteins was made in PBS from 5 mm$^2$ of paper during a 48 hour time period at 4° C. The amount of hGH eluted was determined by a commercial ELISA specific for hGH (Roche).

Wild-type hGH polypeptide was degraded by 3 hours post-injection, whereas the modified hGH polypeptides were found in serum at 24 and 30 hours post-injection. Thus, modified hGH polypeptides provided herein are more proteolytically stable in vivo than wild-type hGH polypeptide.

Since modifications will be apparent to those of skill in this art, it is intended that this invention be limited only by the scope of the appended claims.

SEQUENCE LISTING (719 sequences)

SEQ ID NO: 1 - protein, 191 aa, Homo Sapiens [sequence omitted]

SEQ ID NO: 2 - protein, 191 aa, Homo Sapiens
IATIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 3 - protein, 191 aa, Homo Sapiens
ISTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 4 - protein, 191 aa, Homo Sapiens
VATIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 5 - protein, 191 aa, Homo Sapiens
VSTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 6 - protein, 191 aa, Homo Sapiens
FPTIALSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 7 - protein, 191 aa, Homo Sapiens
FPTISLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 8 - protein, 191 aa, Homo Sapiens
FPTIPISRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 9 - protein, 191 aa, Homo Sapiens
FPTIPVSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 10 - protein, 191 aa, Homo Sapiens
FPTIPLSHLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 11 - protein, 191 aa, Homo Sapiens
FPTIPLSQLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 12 - protein, 191 aa, Homo Sapiens
FPTIPLSRIFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 13 - protein, 191 aa, Homo Sapiens
FPTIPLSRVFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 14 - protein, 191 aa, Homo Sapiens
FPTIPLSRLIDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 15 - protein, 191 aa, Homo Sapiens
FPTIPLSRLVDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 16 - protein, 191 aa, Homo Sapiens
FPTIPLSRLFNNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 17 - protein, 191 aa, Homo Sapiens
FPTIPLSRLFQNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 18 - protein, 191 aa, Homo Sapiens
FPTIPLSRLFDNAILRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 19 - protein, 191 aa, Homo Sapiens
FPTIPLSRLFDNAVLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 20 - protein, 191 aa, Homo Sapiens
FPTIPLSRLFDNAMIRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 21 - protein, 191 aa, Homo Sapiens
FPTIPLSRLFDNAMVRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 22 - protein, 191 aa, Homo Sapiens
FPTIPLSRLFDNAMLHAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 23 - protein, 191 aa, Homo Sapiens
FPTIPLSRLFDNAMLQAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 24 - protein, 191 aa, Homo Sapiens
FPTIPLSRLFDNAMLRAHHLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 25 - protein, 191 aa, Homo Sapiens
FPTIPLSRLFDNAMLRAHQLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 26 - protein, 191 aa, Homo Sapiens
FPTIPLSRLFDNAMLRAHRIHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 27 - protein, 191 aa, Homo Sapiens
FPTIPLSRLFDNAMLRAHRVHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 28 - protein, 191 aa, Homo Sapiens
FPTIPLSRLFDNAMLRAHRLHQIAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 29 - protein, 191 aa, Homo Sapiens
FPTIPLSRLFDNAMLRAHRLHQVAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 30 - protein, 191 aa, Homo Sapiens
FPTIPLSRLFDNAMLRAHRLHQLAIDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 31 - protein, 191 aa, Homo Sapiens
FPTIPLSRLFDNAMLRAHRLHQLAVDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 32 - protein, 191 aa, Homo Sapiens
FPTIPLSRLFDNAMLRAHRLHQLAFNTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 33 - protein, 191 aa, Homo Sapiens
FPTIPLSRLFDNAMLRAHRLHQLAFQTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 34 - protein, 191 aa, Homo Sapiens
FPTIPLSRLFDNAMLRAHRLHQLAFDTHQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 35 - protein, 191 aa, Homo Sapiens
FPTIPLSRLFDNAMLRAHRLHQLAFDTIQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 36 - protein, 191 aa, Homo Sapiens
FPTIPLSRLFDNAMLRAHRLHQLAFDTYQQFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 37 - protein, 191 aa, Homo Sapiens
FPTIPLSRLFDNAMLRAHRLHQLAFDTYQHFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 38 - protein, 191 aa, Homo Sapiens
FPTIPLSRLFDNAMLRAHRLHQLAFDTYQNFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 39 - protein, 191 aa, Homo Sapiens
FPTIPLSRLFDNAMLRAHRLHQLAFDTYQEIEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 40 - protein, 191 aa, Homo Sapiens
FPTIPLSRLFDNAMLRAHRLHQLAFDTYQEVEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 41 - protein, 191 aa, Homo Sapiens
FPTIPLSRLFDNAMLRAHRLHQLAFDTYQEFQEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 42 - protein, 191 aa, Homo Sapiens
FPTIPLSRLFDNAMLRAHRLHQLAFDTYQEFHEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 43 - protein, 191 aa, Homo Sapiens
FPTIPLSRLFDNAMLRAHRLHQLAFDTYQEFNEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 44 - protein, 191 aa, Homo Sapiens
FPTIPLSRLFDNAMLRAHRLHQLAFDTYQEFEQAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 45 - protein, 191 aa, Homo Sapiens
FPTIPLSRLFDNAMLRAHRLHQLAFDTYQEFEHAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 46 - protein, 191 aa, Homo Sapiens
FPTIPLSRLFDNAMLRAHRLHQLAFDTYQEFENAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 47 - protein, 191 aa, Homo Sapiens
FPTIPLSRLFDNAMLRAHRLHQLAFDTYQEFEEAHIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 48 - protein, 191 aa, Homo Sapiens
FPTIPLSRLFDNAMLRAHRLHQLAFDTYQEFEEAIIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 49 - protein, 191 aa, Homo Sapiens
FPTIPLSRLFDNAMLRAHRLHQLAFDTYQEFEEAYIAKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 50 - protein, 191 aa, Homo Sapiens
FPTIPLSRLFDNAMLRAHRLHQLAFDTYQEFEEAYISKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 51 - protein, 191 aa, Homo Sapiens
FPTIPLSRLFDNAMLRAHRLHQLAFDTYQEFEEAYIPNEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 52 - protein, 191 aa, Homo Sapiens
FPTIPLSRLFDNAMLRAHRLHQLAFDTYQEFEEAYIPQEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 53 - protein, 191 aa, Homo Sapiens
FPTIPLSRLFDNAMLRAHRLHQLAFDTYQEFEEAYIPKQQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 54 - protein, 191 aa, Homo Sapiens
FPTIPLSRLFDNAMLRAHRLHQLAFDTYQEFEEAYIPKHQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 55 - protein, 191 aa, Homo Sapiens
FPTIPLSRLFDNAMLRAHRLHQLAFDTYQEFEEAYIPKNQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 56 - protein, 191 aa, Homo Sapiens
FPTIPLSRLFDNAMLRAHRLHQLAFDTYQEFEEAYIPKEQNYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 57 - protein, 191 aa, Homo Sapiens
FPTIPLSRLFDNAMLRAHRLHQLAFDTYQEFEEAYIPKEQQYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 58 - protein, 191 aa, Homo Sapiens
FPTIPLSRLFDNAMLRAHRLHQLAFDTYQEFEEAYIPKEQKHSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 59 - protein, 191 aa, Homo Sapiens
FPTIPLSRLFDNAMLRAHRLHQLAFDTYQEFEEAYIPKEQKISFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 60 - protein, 191 aa, Homo Sapiens
FPTIPLSRLFDNAMLRAHRLHQLAFDTYQEFEEAYIPKEQKYSILQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 61 - protein, 191 aa, Homo Sapiens
FPTIPLSRLFDNAMLRAHRLHQLAFDTYQEFEEAYIPKEQKYSVLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 62 - protein, 191 aa, Homo Sapiens
FPTIPLSRLFDNAMLRAHRLHQLAFDTYQEFEEAYIPKEQKYSFIQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 63 - protein, 191 aa, Homo Sapiens
FPTIPLSRLFDNAMLRAHRLHQLAFDTYQEFEEAYIPKEQKYSFVQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 64 - protein, 191 aa, Homo Sapiens
FPTIPLSRLFDNAMLRAHRLHQLAFDTYQEFEEAYIPKEQKYSFLQNAQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 65 - protein, 191 aa, Homo Sapiens
FPTIPLSRLFDNAMLRAHRLHQLAFDTYQEFEEAYIPKEQKYSFLQNSQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 66 - protein, 191 aa, Homo Sapiens
FPTIPLSRLFDNAMLRAHRLHQLAFDTYQEFEEAYIPKEQKYSFLQNPQTSICFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 67 - protein, 191 aa, Homo Sapiens
FPTIPLSRLFDNAMLRAHRLHQLAFDTYQEFEEAYIPKEQKYSFLQNPQTSVCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 68 - protein, 191 aa, Homo Sapiens
FPTIPLSRLFDNAMLRAHRLHQLAFDTYQEFEEAYIPKEQKYSFLQNPQTSLCISESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 69 - protein, 191 aa, Homo Sapiens
FPTIPLSRLFDNAMLRAHRLHQLAFDTYQEFEEAYIPKEQKYSFLQNPQTSLCVSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 70 - protein, 191 aa, Homo Sapiens
FPTIPLSRLFDNAMLRAHRLHQLAFDTYQEFEEAYIPKEQKYSFLQNPQTSLCFSQSIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 71 - protein, 191 aa, Homo Sapiens
FPTIPLSRLFDNAMLRAHRLHQLAFDTYQEFEEAYIPKEQKYSFLQNPQTSLCFSHSIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 72 - protein, 191 aa, Homo Sapiens
FPTIPLSRLFDNAMLRAHRLHQLAFDTYQEFEEAYIPKEQKYSFLQNPQTSLCFSNSIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 73 - protein, 191 aa, Homo Sapiens
FPTIPLSRLFDNAMLRAHRLHQLAFDTYQEFEEAYIPKEQKYSFLQNPQTSLCFSESIATPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 74 - protein, 191 aa, Homo Sapiens
FPTIPLSRLFDNAMLRAHRLHQLAFDTYQEFEEAYIPKEQKYSFLQNPQTSLCFSESISTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 75 - protein, 191 aa, Homo Sapiens
FPTIPLSRLFDNAMLRAHRLHQLAFDTYQEFEEAYIPKEQKYSFLQNPQTSLCFSESIPTASNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 76 - protein, 191 aa, Homo Sapiens
FPTIPLSRLFDNAMLRAHRLHQLAFDTYQEFEEAYIPKEQKYSFLQNPQTSLCFSESIPTSSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 77 - protein, 191 aa, Homo Sapiens
FPTIPLSRLFDNAMLRAHRLHQLAFDTYQEFEEAYIPKEQKYSFLQNPQTSLCFSESIPTPSNHEETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 78 - protein, 191 aa, Homo Sapiens
FPTIPLSRLFDNAMLRAHRLHQLAFDTYQEFEEAYIPKEQKYSFLQNPQTSLCFSESIPTPSNQEETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 79 - protein, 191 aa, Homo Sapiens
FPTIPLSRLFDNAMLRAHRLHQLAFDTYQEFEEAYIPKEQKYSFLQNPQTSLCFSESIPTPSNRQETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 80 - protein, 191 aa, Homo Sapiens
FPTIPLSRLFDNAMLRAHRLHQLAFDTYQEFEEAYIPKEQKYSFLQNPQTSLCFSESIPTPSNRHETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 81 - protein, 191 aa, Homo Sapiens
FPTIPLSRLFDNAMLRAHRLHQLAFDTYQEFEEAYIPKEQKYSFLQNPQTSLCFSESIPTPSNRNETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 82 - protein, 191 aa, Homo Sapiens
FPTIPLSRLFDNAMLRAHRLHQLAFDTYQEFEEAYIPKEQKYSFLQNPQTSLCFSESIPTPSNREQTQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 83 - protein, 191 aa, Homo Sapiens
FPTIPLSRLFDNAMLRAHRLHQLAFDTYQEFEEAYIPKEQKYSFLQNPQTSLCFSESIPTPSNREHTQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 84 - protein, 191 aa, Homo Sapiens
FPTIPLSRLFDNAMLRAHRLHQLAFDTYQEFEEAYIPKEQKYSFLQNPQTSLCFSESIPTPSNRENTQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 85 - protein, 191 aa, Homo Sapiens
FPTIPLSRLFDNAMLRAHRLHQLAFDTYQEFEEAYIPKEQKYSFLQNPQTSLCFSESIPTPSNREETQQNSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 86 - protein, 191 aa, Homo Sapiens
FPTIPLSRLFDNAMLRAHRLHQLAFDTYQEFEEAYIPKEQKYSFLQNPQTSLCFSESIPTPSNREETQQQSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 87 - protein, 191 aa, Homo Sapiens
FPTIPLSRLFDNAMLRAHRLHQLAFDTYQEFEEAYIPKEQKYSFLQNPQTSLCFSESIPTPSNREETQQKSNIELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 88 - protein, 191 aa, Homo Sapiens
FPTIPLSRLFDNAMLRAHRLHQLAFDTYQEFEEAYIPKEQKYSFLQNPQTSLCFSESIPTPSNREETQQKSNVELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 89 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLQLLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 90 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLHLLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 91 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLNLLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 92 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLEILRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 93 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLEVLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 94 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELIRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 95 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELVRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 96 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLHISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 97 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLQISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 98 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISILLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 99 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISVLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 100 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLILIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 101 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLVLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 102 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLIIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 103 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLVIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 104 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSHLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 105 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSSLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 106 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWIEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 107 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWVEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 108 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLQPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 109 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLHPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 110 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLNPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 111 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEAVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 112 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLESVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 113 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQILRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 114 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQVLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 115 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFIRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 116 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFVRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 117 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLHSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 118 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLQSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 119 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVIANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 120 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVVANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 121 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSIVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 122 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSVVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 123 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVHGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 124 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVIGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 125 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASNSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 126 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASQSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 127 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVHDLLKDLEEGIQTLMGRLEDGSPRTGQIFKQTYSKFDTNSHNDDALLKNYGLLYCFRKDMDKVETFLRIVQCRSVEGSCGF

SEQ ID NO: 128 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVIDLLKDLEEGIQTLMGRLEDGSPRTGQIFKQTYSKFDTNSHNDDALLKNYGLLYCFRKDMDKVETFLRIVQCRSVEGSCGF

SEQ ID NO: 129 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYNLLKDLEEGIQTLMGRLEDGSPRTGQIFKQTYSKFDTNSHNDDALLKNYGLLYCFRKDMDKVETFLRIVQCRSVEGSCGF

SEQ ID NO: 130 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYQLLKDLEEGIQTLMGRLEDGSPRTGQIFKQTYSKFDTNSHNDDALLKNYGLLYCFRKDMDKVETFLRIVQCRSVEGSCGF

SEQ ID NO: 131 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDILKDLEEGIQTLMGRLEDGSPRTGQIFKQTYSKFDTNSHNDDALLKNYGLLYCFRKDMDKVETFLRIVQCRSVEGSCGF

SEQ ID NO: 132 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDVLKDLEEGIQTLMGRLEDGSPRTGQIFKQTYSKFDTNSHNDDALLKNYGLLYCFRKDMDKVETFLRIVQCRSVEGSCGF

SEQ ID NO: 133 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLIKDLEEGIQTLMGRLEDGSPRTGQIFKQTYSKFDTNSHNDDALLKNYGLLYCFRKDMDKVETFLRIVQCRSVEGSCGF

SEQ ID NO: 134 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLVKDLEEGIQTLMGRLEDGSPRTGQIFKQTYSKFDTNSHNDDALLKNYGLLYCFRKDMDKVETFLRIVQCRSVEGSCGF

SEQ ID NO: 135 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLNDLEEGIQTLMGRLEDGSPRTGQIFKQTYSKFDTNSHNDDALLKNYGLLYCFRKDMDKVETFLRIVQCRSVEGSCGF

SEQ ID NO: 136 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLQDLEEGIQTLMGRLEDGSPRTGQIFKQTYSKFDTNSHNDDALLKNYGLLYCFRKDMDKVETFLRIVQCRSVEGSCGF

SEQ ID NO: 137 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKNLEEGIQTLMGRLEDGSPRTGQIFKQTYSKFDTNSHNDDALLKNYGLLYCFRKDMDKVETFLRIVQCRSVEGSCGF

SEQ ID NO: 138 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKQLEEGIQTLMGRLEDGSPRTGQIFKQTYSKFDTNSHNDDALLKNYGLLYCFRKDMDKVETFLRIVQCRSVEGSCGF

SEQ ID NO: 139 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDIEEGIQTLMGRLEDGSPRTGQIFKQTYSKFDTNSHNDDALLKNYGLLYCFRKDMDKVETFLRIVQCRSVEGSCGF

SEQ ID NO: 140 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDVEEGIQTLMGRLEDGSPRTGQIFKQTYSKFDTNSHNDDALLKNYGLLYCFRKDMDKVETFLRIVQCRSVEGSCGF

SEQ ID NO: 141 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLQEGIQTLMGRLEDGSPRTGQIFKQTYSKFDTNSHNDDALLKNYGLLYCFRKDMDKVETFLRIVQCRSVEGSCGF

SEQ ID NO: 142 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLHEGIQTLMGRLEDGSPRTGQIFKQTYSKFDTNSHNDDALLKNYGLLYCFRKDMDKVETFLRIVQCRSVEGSCGF

SEQ ID NO: 143 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLNEGIQTLMGRLEDGSPRTGQIFKQTYSKFDTNSHNDDALLKNYGLLYCFRKDMDKVETFLRIVQCRSVEGSCGF

SEQ ID NO: 144 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEQGIQTLMGRLEDGSPRTGQIFKQTYSKFDTNSHNDDALLKNYGLLYCFRKDMDKVETFLRIVQCRSVEGSCGF

SEQ ID NO: 145 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEHGIQTLMGRLEDGSPRTGQIFKQTYSKFDTNSHNDDALLKNYGLLYCFRKDMDKVETFLRIVQCRSVEGSCGF

SEQ ID NO: 146 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLENGIQTLMGRLEDGSPRTGQIFKQTYSKFDTNSHNDDALLKNYGLLYCFRKDMDKVETFLRIVQCRSVEGSCGF

SEQ ID NO: 147 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTIMGRLEDGSPRTGQIFKQTYSKFDTNSHNDDALLKNYGLLYCFRKDMDKVETFLRIVQCRSVEGSCGF

SEQ ID NO: 148 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTVMGRLEDGSPRTGQIFKQTYSKFDTNSHNDDALLKNYGLLYCFRKDMDKVETFLRIVQCRSVEGSCGF

SEQ ID NO: 149 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLIGRLEDGSPRTGQIFKQTYSKFDTNSHNDDALLKNYGLLYCFRKDMDKVETFLRIVQCRSVEGSCGF

SEQ ID NO: 150 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLVGRLEDGSPRTGQIFKQTYSKFDTNSHNDDALLKNYGLLYCFRKDMDKVETFLRIVQCRSVEGSCGF

SEQ ID NO: 151 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGHLEDGSPRTGQIFKQTYSKFDTNSHNDDALLKNYGLLYCFRKDMDKVETFLRIVQCRSVEGSCGF

SEQ ID NO: 152 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGQLEDGSPRTGQIFKQTYSKFDTNSHNDDALLKNYGLLYCFRKDMDKVETFLRIVQCRSVEGSCGF

SEQ ID NO: 153 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRIEDGSPRTGQIFKQTYSKFDTNSHNDDALLKNYGLLYCFRKDMDKVETFLRIVQCRSVEGSCGF

SEQ ID NO: 154 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRVEDGSPRTGQIFKQTYSKFDTNSHNDDALLKNYGLLYCFRKDMDKVETFLRIVQCRSVEGSCGF

SEQ ID NO: 155 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLQDGSPRTGQIFKQTYSKFDTNSHNDDALLKNYGLLYCFRKDMDKVETFLRIVQCRSVEGSCGF

SEQ ID NO: 156 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLHDGSPRTGQIFKQTYSKFDTNSHNDDALLKNYGLLYCFRKDMDKVETFLRIVQCRSVEGSCGF

SEQ ID NO: 157 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLNDGSPRTGQIFKQTYSKFDTNSHNDDALLKNYGLLYCFRKDMDKVETFLRIVQCRSVEGSCGF

SEQ ID NO: 158 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLENGSPRTGQIFKQTYSKFDTNSHNDDALLKNYGLLYCFRKDMDKVETFLRIVQCRSVEGSCGF

SEQ ID NO: 159 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEQGSPRTGQIFKQTYSKFDTNSHNDDALLKNYGLLYCFRKDMDKVETFLRIVQCRSVEGSCGF

SEQ ID NO: 160 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSARTGQIFKQTYSKFDTNSHNDDALLKNYGLLYCFRKDMDKVETFLRIVQCRSVEGSCGF

SEQ ID NO: 161 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSSRTGQIFKQTYSKFDTNSHNDDALLKNYGLLYCFRKDMDKVETFLRIVQCRSVEGSCGF

SEQ ID NO: 162 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPHTGQIFKQTYSKFDTNSHNDDALLKNYGLLYCFRKDMDKVETFLRIVQCRSVEGSCGF

SEQ ID NO: 163 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPQTGQIFKQTYSKFDTNSHNDDALLKNYGLLYCFRKDMDKVETFLRIVQCRSVEGSCGF

SEQ ID NO: 164 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIIKQTYSKFDTNSHNDDALLKNYGLLYCFRKDMDKVETFLRIVQCRSVEGSCGF

SEQ ID NO: 165 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIVKQTYSKFDTNSHNDDALLKNYGLLYCFRKDMDKVETFLRIVQCRSVEGSCGF

SEQ ID NO: 166 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFNQTYSKFDTNSHNDDALLKNYGLLYCFRKDMDKVETFLRIVQCRSVEGSCGF

SEQ ID NO: 167 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFQQTYSKFDTNSHNDDALLKNYGLLYCFRKDMDKVETFLRIVQCRSVEGSCGF

SEQ ID NO: 168 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTHSKFDTNSHNDDALLKNYGLLYCFRKDMDKVETFLRIVQCRSVEGSCGF

SEQ ID NO: 169 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTISKFDTNSHNDDALLKNYGLLYCFRKDMDKVETFLRIVQCRSVEGSCGF

SEQ ID NO: 170 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSNFDTNSHNDDALLKNYGLLYCFRKDMDKVETFLRIVQCRSVEGSCGF

SEQ ID NO: 171 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSQFDTNSHNDDALLKNYGLLYCFRKDMDKVETFLRIVQCRSVEGSCGF

SEQ ID NO: 172 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKIDTNSHNDDALLKNYGLLYCFRKDMDKVETFLRIVQCRSVEGSCGF

SEQ ID NO: 173 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKVDTNSHNDDALLKNYGLLYCFRKDMDKVETFLRIVQCRSVEGSCGF

SEQ ID NO: 174 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFNTNSHNDDALLKNYGLLYCFRKDMDKVETFLRIVQCRSVEGSCGF

SEQ ID NO: 175 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFQTNSHNDDALLKNYGLLYCFRKDMDKVETFLRIVQCRSVEGSCGF

SEQ ID NO: 176 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNNDALLKNYGLLYCFRKDMDKVETFLRIVQCRSVEGSCGF

SEQ ID NO: 177 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNQDALLKNYGLLYCFRKDMDKVETFLRIVQCRSVEGSCGF

SEQ ID NO: 178 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDNALLKNYGLLYCFRKDMDKVETFLRIVQCRSVEGSCGF

SEQ ID NO: 179 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDQALLKNYGLLYCFRKDMDKVETFLRIVQCRSVEGSCGF

SEQ ID NO: 180 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDAILKNYGLLYCFRKDMDKVETFLRIVQCRSVEGSCGF

SEQ ID NO: 181 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDAVLKNYGLLYCFRKDMDKVETFLRIVQCRSVEGSCGF

SEQ ID NO: 182 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALIKNYGLLYCFRKDMDKVETFLRIVQCRSVEGSCGF

SEQ ID NO: 183 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALVKNYGLLYCFRKDMDKVETFLRIVQCRSVEGSCGF

SEQ ID NO: 184 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLNNYGLLYCFRKDMDKVETFLRIVQCRSVEGSCGF

SEQ ID NO: 185 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLQNYGLLYCFRKDMDKVETFLRIVQCRSVEGSCGF

SEQ ID NO: 186 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNHGLLYCFRKDMDKVETFLRIVQCRSVEGSCGF

SEQ ID NO: 187 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNIGLLYCFRKDMDKVETFLRIVQCRSVEGSCGF

SEQ ID NO: 188 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGILYCFRKDMDKVETFLRIVQCRSVEGSCGF

SEQ ID NO: 189 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGVLYCFRKDMDKVETFLRIVQCRSVEGSCGF

SEQ ID NO: 190 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLIYCFRKDMDKVETFLRIVQCRSVEGSCGF

SEQ ID NO: 191 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLVYCFRKDMDKVETFLRIVQCRSVEGSCGF

SEQ ID NO: 192 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLHCFRKDMDKVETFLRIVQCRSVEGSCGF

SEQ ID NO: 193 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLICFRKDMDKVETFLRIVQCRSVEGSCGF

SEQ ID NO: 194 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCIRKDMDKVETFLRIVQCRSVEGSCGF

SEQ ID NO: 195 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCVRKDMDKVETFLRIVQCRSVEGSCGF

SEQ ID NO: 196 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFHKDMDKVETFLRIVQCRSVEGSCGF

SEQ ID NO: 197 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFQKDMDKVETFLRIVQCRSVEGSCGF

SEQ ID NO: 198 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRNDMDKVETFLRIVQCRSVEGSCGF

SEQ ID NO: 199 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRQDMDKVETFLRIVQCRSVEGSCGF

SEQ ID NO: 200 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKNMDKVETFLRIVQCRSVEGSCGF

SEQ ID NO: 201 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKQMDKVETFLRIVQCRSVEGSCGF

SEQ ID NO: 202 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDIDKVETFLRIVQCRSVEGSCGF

SEQ ID NO: 203 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDVDKVETFLRIVQCRSVEGSCGF

SEQ ID NO: 204 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMNKVETFLRIVQCRSVEGSCGF

SEQ ID NO: 205 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMQKVETFLRIVQCRSVEGSCGF

SEQ ID NO: 206 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDNVETFLRIVQCRSVEGSCGF

SEQ ID NO: 207 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDQVETFLRIVQCRSVEGSCGF

SEQ ID NO: 208 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVQTFLRIVQCRSVEGSCGF

SEQ ID NO: 209 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVHTFLRIVQCRSVEGSCGF

SEQ ID NO: 210 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVNTFLRIVQCRSVEGSCGF

SEQ ID NO: 211 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETILRIVQCRSVEGSCGF

SEQ ID NO: 212 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETVLRIVQCRSVEGSCGF

SEQ ID NO: 213 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFIRIVQCRSVEGSCGF

SEQ ID NO: 214 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFVRIVQCRSVEGSCGF

SEQ ID NO: 215 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLHIVQCRSVEGSCGF

SEQ ID NO: 216 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLQIVQCRSVEGSCGF

SEQ ID NO: 217 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCHSVEGSCGF

SEQ ID NO: 218 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCQSVEGSCGF

SEQ ID NO: 219 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVQGSCGF

SEQ ID NO: 220 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVHGSCGF

SEQ ID NO: 221 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVNGSCGF

SEQ ID NO: 222 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGI

SEQ ID NO: 223 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGV

SEQ ID NO: 224 - protein, 191 aa, Homo Sapiens
FPTIPESRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 225 - protein, 191 aa, Homo Sapiens
FPTIPDSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 226 - protein, 191 aa, Homo Sapiens
FPTIPKSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 227 - protein, 191 aa, Homo Sapiens
FPTIPRSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 228 - protein, 191 aa, Homo Sapiens
FPTIPNSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 229 - protein, 191 aa, Homo Sapiens
FPTIPQSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 230 - protein, 191 aa, Homo Sapiens
FPTIPSSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 231 - protein, 191 aa, Homo Sapiens
FPTIPTSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 232 - protein, 191 aa, Homo Sapiens
FPTIPLSREFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 233 - protein, 191 aa, Homo Sapiens
FPTIPLSRDFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 234 - protein, 191 aa, Homo Sapiens
FPTIPLSRKFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 235 - protein, 191 aa, Homo Sapiens
FPTIPLSRRFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 236 - protein, 191 aa, Homo Sapiens
FPTIPLSRNFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 237 - protein, 191 aa, Homo Sapiens
FPTIPLSRQFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 238 - protein, 191 aa, Homo Sapiens
FPTIPLSRSFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 239 - protein, 191 aa, Homo Sapiens
FPTIPLSRTFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 240 - protein, 191 aa, Homo Sapiens
FPTIPLSRLFDNEMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 241 - protein, 191 aa, Homo Sapiens
FPTIPLSRLFDNDMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 242 - protein, 191 aa, Homo Sapiens
FPTIPLSRLFDNKMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 243 - protein, 191 aa, Homo Sapiens
FPTIPLSRLFDNRMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 244 - protein, 191 aa, Homo Sapiens
FPTIPLSRLFDNNMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 245 - protein, 191 aa, Homo Sapiens
FPTIPLSRLFDNQMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 246 - protein, 191 aa, Homo Sapiens
FPTIPLSRLFDNSMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 247 - protein, 191 aa, Homo Sapiens
FPTIPLSRLFDNTMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 248 - protein, 191 aa, Homo Sapiens
FPTIPLSRLFDNAMERAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 249 - protein, 191 aa, Homo Sapiens
FPTIPLSRLFDNAMDRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 250 - protein, 191 aa, Homo Sapiens
FPTIPLSRLFDNAMKRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 251 - protein, 191 aa, Homo Sapiens
FPTIPLSRLFDNAMRRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 252 - protein, 191 aa, Homo Sapiens
FPTIPLSRLFDNAMNRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 253 - protein, 191 aa, Homo Sapiens
FPTIPLSRLFDNAMQRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 254 - protein, 191 aa, Homo Sapiens
FPTIPLSRLFDNAMSRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 255 - protein, 191 aa, Homo Sapiens
FPTIPLSRLFDNAMTRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 256 - protein, 191 aa, Homo Sapiens
FPTIPLSRLFDNAMLREHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 257 - protein, 191 aa, Homo Sapiens
FPTIPLSRLFDNAMLRDHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 258 - protein, 191 aa, Homo Sapiens
FPTIPLSRLFDNAMLRKHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 259 - protein, 191 aa, Homo Sapiens
FPTIPLSRLFDNAMLRRHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 260 - protein, 191 aa, Homo Sapiens
FPTIPLSRLFDNAMLRNHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 261 - protein, 191 aa, Homo Sapiens
FPTIPLSRLFDNAMLRQHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 262 - protein, 191 aa, Homo Sapiens
FPTIPLSRLFDNAMLRSHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 263 - protein, 191 aa, Homo Sapiens
FPTIPLSRLFDNAMLRTHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 264 - protein, 191 aa, Homo Sapiens
FPTIPLSRLFDNAMLRAHREHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 265 - protein, 191 aa, Homo Sapiens
FPTIPLSRLFDNAMLRAHRDHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 266 - protein, 191 aa, Homo Sapiens
FPTIPLSRLFDNAMLRAHRKHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 267 - protein, 191 aa, Homo Sapiens
FPTIPLSRLFDNAMLRAHRRHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 268 - protein, 191 aa, Homo Sapiens
FPTIPLSRLFDNAMLRAHRNHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 269 - protein, 191 aa, Homo Sapiens
FPTIPLSRLFDNAMLRAHRQHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 270 - protein, 191 aa, Homo Sapiens
FPTIPLSRLFDNAMLRAHRSHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 271 - protein, 191 aa, Homo Sapiens
FPTIPLSRLFDNAMLRAHRTHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 272 - protein, 191 aa, Homo Sapiens
FPTIPLSRLFDNAMLRAHRLHQEAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 273 - protein, 191 aa, Homo Sapiens
FPTIPLSRLFDNAMLRAHRLHQDAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 274 - protein, 191 aa, Homo Sapiens
FPTIPLSRLFDNAMLRAHRLHQKAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 275 - protein, 191 aa, Homo Sapiens
FPTIPLSRLFDNAMLRAHRLHQRAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 276 - protein, 191 aa, Homo Sapiens
FPTIPLSRLFDNAMLRAHRLHQNAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 277 - protein, 191 aa, Homo Sapiens
FPTIPLSRLFDNAMLRAHRLHQQAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 278 - protein, 191 aa, Homo Sapiens
FPTIPLSRLFDNAMLRAHRLHQSAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 279 - protein, 191 aa, Homo Sapiens
FPTIPLSRLFDNAMLRAHRLHQTAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 280 - protein, 191 aa, Homo Sapiens
FPTIPLSRLFDNAMLRAHRLHQLEFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 281 - protein, 191 aa, Homo Sapiens
FPTIPLSRLFDNAMLRAHRLHQLDFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 282 - protein, 191 aa, Homo Sapiens
FPTIPLSRLFDNAMLRAHRLHQLKFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 283 - protein, 191 aa, Homo Sapiens
FPTIPLSRLFDNAMLRAHRLHQLRFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 284 - protein, 191 aa, Homo Sapiens
FPTIPLSRLFDNAMLRAHRLHQLNFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 285 - protein, 191 aa, Homo Sapiens
FPTIPLSRLFDNAMLRAHRLHQLQFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 286 - protein, 191 aa, Homo Sapiens
FPTIPLSRLFDNAMLRAHRLHQLSFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 287 - protein, 191 aa, Homo Sapiens
FPTIPLSRLFDNAMLRAHRLHQLTFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 288 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGESDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 289 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGDSDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 290 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGKSDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 291 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGRSDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 292 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGNSDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 293 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGQSDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 294 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGSSDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 295 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGTSDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 296 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNEYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 297 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNDYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 298 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNKYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 299 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNRYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 300 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNNYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 301 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNQYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 302 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNSYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 303 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNTYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 304 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDELKDLEEGIQTLMGRLEDGSPRTGQIFKQTYSKFDTNSHNDDALLKNYGLLYCFRKDMDKVETFLRIVQCRSVEGSCGF

SEQ ID NO: 305 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDDLKDLEEGIQTLMGRLEDGSPRTGQIFKQTYSKFDTNSHNDDALLKNYGLLYCFRKDMDKVETFLRIVQCRSVEGSCGF

SEQ ID NO: 306 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDKLKDLEEGIQTLMGRLEDGSPRTGQIFKQTYSKFDTNSHNDDALLKNYGLLYCFRKDMDKVETFLRIVQCRSVEGSCGF

SEQ ID NO: 307 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDRLKDLEEGIQTLMGRLEDGSPRTGQIFKQTYSKFDTNSHNDDALLKNYGLLYCFRKDMDKVETFLRIVQCRSVEGSCGF

SEQ ID NO: 308 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDNLKDLEEGIQTLMGRLEDGSPRTGQIFKQTYSKFDTNSHNDDALLKNYGLLYCFRKDMDKVETFLRIVQCRSVEGSCGF

SEQ ID NO: 309 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDQLKDLEEGIQTLMGRLEDGSPRTGQIFKQTYSKFDTNSHNDDALLKNYGLLYCFRKDMDKVETFLRIVQCRSVEGSCGF

SEQ ID NO: 310 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDSLKDLEEGIQTLMGRLEDGSPRTGQIFKQTYSKFDTNSHNDDALLKNYGLLYCFRKDMDKVETFLRIVQCRSVEGSCGF

SEQ ID NO: 311 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDTLKDLEEGIQTLMGRLEDGSPRTGQIFKQTYSKFDTNSHNDDALLKNYGLLYCFRKDMDKVETFLRIVQCRSVEGSCGF

SEQ ID NO: 312 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLEKDLEEGIQTLMGRLEDGSPRTGQIFKQTYSKFDTNSHNDDALLKNYGLLYCFRKDMDKVETFLRIVQCRSVEGSCGF

SEQ ID NO: 313 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLDKDLEEGIQTLMGRLEDGSPRTGQIFKQTYSKFDTNSHNDDALLKNYGLLYCFRKDMDKVETFLRIVQCRSVEGSCGF

SEQ ID NO: 314 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLKKDLEEGIQTLMGRLEDGSPRTGQIFKQTYSKFDTNSHNDDALLKNYGLLYCFRKDMDKVETFLRIVQCRSVEGSCGF

SEQ ID NO: 315 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLRKDLEEGIQTLMGRLEDGSPRTGQIFKQTYSKFDTNSHNDDALLKNYGLLYCFRKDMDKVETFLRIVQCRSVEGSCGF

SEQ ID NO: 316 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLNKDLEEGIQTLMGRLEDGSPRTGQIFKQTYSKFDTNSHNDDALLKNYGLLYCFRKDMDKVETFLRIVQCRSVEGSCGF

SEQ ID NO: 317 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLQKDLEEGIQTLMGRLEDGSPRTGQIFKQTYSKFDTNSHNDDALLKNYGLLYCFRKDMDKVETFLRIVQCRSVEGSCGF

SEQ ID NO: 318 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLSKDLEEGIQTLMGRLEDGSPRTGQIFKQTYSKFDTNSHNDDALLKNYGLLYCFRKDMDKVETFLRIVQCRSVEGSCGF

SEQ ID NO: 319 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLTKDLEEGIQTLMGRLEDGSPRTGQIFKQTYSKFDTNSHNDDALLKNYGLLYCFRKDMDKVETFLRIVQCRSVEGSCGF

SEQ ID NO: 320 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDEEEGIQTLMGRLEDGSPRTGQIFKQTYSKFDTNSHNDDALLKNYGLLYCFRKDMDKVETFLRIVQCRSVEGSCGF

SEQ ID NO: 321 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDDEEGIQTLMGRLEDGSPRTGQIFKQTYSKFDTNSHNDDALLKNYGLLYCFRKDMDKVETFLRIVQCRSVEGSCGF

SEQ ID NO: 322 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDKEEGIQTLMGRLEDGSPRTGQIFKQTYSKFDTNSHNDDALLKNYGLLYCFRKDMDKVETFLRIVQCRSVEGSCGF

SEQ ID NO: 323 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDREEGIQTLMGRLEDGSPRTGQIFKQTYSKFDTNSHNDDALLKNYGLLYCFRKDMDKVETFLRIVQCRSVEGSCGF

SEQ ID NO: 324 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDNEEGIQTLMGRLEDGSPRTGQIFKQTYSKFDTNSHNDDALLKNYGLLYCFRKDMDKVETFLRIVQCRSVEGSCGF

SEQ ID NO: 325 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDQEEGIQTLMGRLEDGSPRTGQIFKQTYSKFDTNSHNDDALLKNYGLLYCFRKDMDKVETFLRIVQCRSVEGSCGF

SEQ ID NO: 326 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDSEEGIQTLMGRLEDGSPRTGQIFKQTYSKFDTNSHNDDALLKNYGLLYCFRKDMDKVETFLRIVQCRSVEGSCGF

SEQ ID NO: 327 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDTEEGIQTLMGRLEDGSPRTGQIFKQTYSKFDTNSHNDDALLKNYGLLYCFRKDMDKVETFLRIVQCRSVEGSCGF

SEQ ID NO: 328 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGEQTLMGRLEDGSPRTGQIFKQTYSKFDTNSHNDDALLKNYGLLYCFRKDMDKVETFLRIVQCRSVEGSCGF

SEQ ID NO: 329 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGDQTLMGRLEDGSPRTGQIFKQTYSKFDTNSHNDDALLKNYGLLYCFRKDMDKVETFLRIVQCRSVEGSCGF

SEQ ID NO: 330 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGKQTLMGRLEDGSPRTGQIFKQTYSKFDTNSHNDDALLKNYGLLYCFRKDMDKVETFLRIVQCRSVEGSCGF

SEQ ID NO: 331 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGRQTLMGRLEDGSPRTGQIFKQTYSKFDTNSHNDDALLKNYGLLYCFRKDMDKVETFLRIVQCRSVEGSCGF

SEQ ID NO: 332 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGNQTLMGRLEDGSPRTGQIFKQTYSKFDTNSHNDDALLKNYGLLYCFRKDMDKVETFLRIVQCRSVEGSCGF

SEQ ID NO: 333 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGQQTLMGRLEDGSPRTGQIFKQTYSKFDTNSHNDDALLKNYGLLYCFRKDMDKVETFLRIVQCRSVEGSCGF

SEQ ID NO: 334 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGSQTLMGRLEDGSPRTGQIFKQTYSKFDTNSHNDDALLKNYGLLYCFRKDMDKVETFLRIVQCRSVEGSCGF

SEQ ID NO: 335 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGTQTLMGRLEDGSPRTGQIFKQTYSKFDTNSHNDDALLKNYGLLYCFRKDMDKVETFLRIVQCRSVEGSCGF

SEQ ID NO: 336 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTEMGRLEDGSPRTGQIFKQTYSKFDTNSHNDDALLKNYGLLYCFRKDMDKVETFLRIVQCRSVEGSCGF

SEQ ID NO: 337 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTDMGRLEDGSPRTGQIFKQTYSKFDTNSHNDDALLKNYGLLYCFRKDMDKVETFLRIVQCRSVEGSCGF

SEQ ID NO: 338 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTKMGRLEDGSPRTGQIFKQTYSKFDTNSHNDDALLKNYGLLYCFRKDMDKVETFLRIVQCRSVEGSCGF

SEQ ID NO: 339 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTRMGRLEDGSPRTGQIFKQTYSKFDTNSHNDDALLKNYGLLYCFRKDMDKVETFLRIVQCRSVEGSCGF

SEQ ID NO: 340 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTNMGRLEDGSPRTGQIFKQTYSKFDTNSHNDDALLKNYGLLYCFRKDMDKVETFLRIVQCRSVEGSCGF

SEQ ID NO: 341 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTQMGRLEDGSPRTGQIFKQTYSKFDTNSHNDDALLKNYGLLYCFRKDMDKVETFLRIVQCRSVEGSCGF

SEQ ID NO: 342 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTSMGRLEDGSPRTGQIFKQTYSKFDTNSHNDDALLKNYGLLYCFRKDMDKVETFLRIVQCRSVEGSCGF

SEQ ID NO: 343 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTTMGRLEDGSPRTGQIFKQTYSKFDTNSHNDDALLKNYGLLYCFRKDMDKVETFLRIVQCRSVEGSCGF

SEQ ID NO: 344 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGREEDGSPRTGQIFKQTYSKFDTNSHNDDALLKNYGLLYCFRKDMDKVETFLRIVQCRSVEGSCGF

SEQ ID NO: 345 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRDEDGSPRTGQIFKQTYSKFDTNSHNDDALLKNYGLLYCFRKDMDKVETFLRIVQCRSVEGSCGF

SEQ ID NO: 346 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRKEDGSPRTGQIFKQTYSKFDTNSHNDDALLKNYGLLYCFRKDMDKVETFLRIVQCRSVEGSCGF

SEQ ID NO: 347 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRREDGSPRTGQIFKQTYSKFDTNSHNDDALLKNYGLLYCFRKDMDKVETFLRIVQCRSVEGSCGF

SEQ ID NO: 348 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRNEDGSPRTGQIFKQTYSKFDTNSHNDDALLKNYGLLYCFRKDMDKVETFLRIVQCRSVEGSCGF

SEQ ID NO: 349 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRQEDGSPRTGQIFKQTYSKFDTNSHNDDALLKNYGLLYCFRKDMDKVETFLRIVQCRSVEGSCGF

SEQ ID NO: 350 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRSEDGSPRTGQIFKQTYSKFDTNSHNDDALLKNYGLLYCFRKDMDKVETFLRIVQCRSVEGSCGF

SEQ ID NO: 351 - protein, 191 aa, Homo Sapiens
FPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRTEDGSPRTGQIFKQTYSKFDTNSHNDDALLKNYGLLYCFRKDMDKVETFLRIVQCRSVEGSCGF

SEQ ID NO: 352 - DNA, 70 bp, Artificial Sequence
  Primer
gggcagtgccatcgccaccattcccttatccaggcgcctggataagggaatggtggcgatggcactgccc

SEQ ID NO: 353 - DNA, 70 bp, Artificial Sequence
  Primer
gggcagtgccatcagcaccattcccttatccaggcgcctggataagggaatggtgctgatggcactgccc

SEQ ID NO: 354 - DNA, 70 bp, Artificial Sequence
  Primer
gggcagtgccgtggccaccattcccttatccaggcgcctggataagggaatggtggccacggcactgccc

SEQ ID NO: 355 - DNA, 70 bp, Artificial Sequence
  Primer
gggcagtgccgtgagcaccattcccttatccaggcgcctggataagggaatggtgctcacggcactgccc

SEQ ID NO: 356 - DNA, 70 bp, Artificial Sequence
  Primer
gggcagtgccttcccaaccattgccttatccaggcgcctggataaggcaatggttgggaaggcactgccc

SEQ ID NO: 357 - DNA, 70 bp, Artificial Sequence
  Primer
gggcagtgccttcccaaccattagcttatccaggcgcctggataagctaatggttgggaaggcactgccc

SEQ ID NO: 358 - DNA, 80 bp, Artificial Sequence
  Primer
ggcagtgccttcccaaccattcccatctccaggctttttgcaaaaagcctggagatgggaatggttgggaaggcactgcc

SEQ ID NO: 359 - DNA, 80 bp, Artificial Sequence
  Primer
ggcagtgccttcccaaccattcccgtgtccaggctttttgcaaaaagcctggacacgggaatggttgggaaggcactgcc

SEQ ID NO: 360 - DNA, 80 bp, Artificial Sequence
  Primer
cattcccttatcccacctttttgacaacgctatgctccgcgcggagcatagcgttgtcaaaaaggtgggataagggaatg

SEQ ID NO: 361 - DNA, 80 bp, Artificial Sequence
  Primer
cattcccttatcccagctttttgacaacgctatgctccgcgcggagcatagcgttgtcaaaaagctgggataagggaatg

SEQ ID NO: 362 - DNA, 80 bp, Artificial Sequence
  Primer
cccttatccaggatctttgacaacgctatgctccgcgcccgggcgcggagcatagcgttgtcaaagatcctggataaggg

SEQ ID NO: 363 - DNA, 80 bp, Artificial Sequence
  Primer
cccttatccagggtgtttgacaacgctatgctccgcgcccgggcgcggagcatagcgttgtcaaacaccctggataaggg

SEQ ID NO: 364 - DNA, 80 bp, Artificial Sequence
  Primer
cccttatccaggcttatcgacaacgctatgctccgcgcccgggcgcggagcatagcgttgtcgataagcctggataaggg

SEQ ID NO: 365 - DNA, 80 bp, Artificial Sequence
  Primer
cccttatccaggcttgtggacaacgctatgctccgcgcccgggcgcggagcatagcgttgtccacaagcctggataaggg

SEQ ID NO: 366 - DNA, 66 bp, Artificial Sequence
  Primer
ccaggctttttaacaacgctatgctccgcgcccgggcgcggagcatagcgttgttaaaaagcctgg

SEQ ID NO: 367 - DNA, 66 bp, Artificial Sequence
  Primer
ccaggctttttcagaacgctatgctccgcgcccgggcgcggagcatagcgttctgaaaaagcctgg

SEQ ID NO: 368 - DNA, 66 bp, Artificial Sequence
  Primer
ccaggctttttgacaacgctatcctccgcgcccgggcgcggaggatagcgttgtcaaaaagcctgg

SEQ ID NO: 369 - DNA, 66 bp, Artificial Sequence
  Primer
ccaggctttttgacaacgctgtgctccgcgcccgggcgcggagcacagcgttgtcaaaaagcctgg

SEQ ID NO: 370 - DNA, 78 bp, Artificial Sequence
  Primer
caacgctatgatccgcgcccatcgtctgcaccagctggcgccagctggtgcagacgatgggcgcggatcatagcgttg

SEQ ID NO: 371 - DNA, 78 bp, Artificial Sequence
  Primer
caacgctatggtgcgcgcccatcgtctgcaccagctggcgccagctggtgcagacgatgggcgcgcaccatagcgttg

SEQ ID NO: 372 - DNA, 74 bp, Artificial Sequence
  Primer
cgctatgctccacgcccatcgtctgcaccagctggccggccagctggtgcagacgatgggcgtggagcatagcg

SEQ ID NO: 373 - DNA, 74 bp, Artificial Sequence
  Primer
cgctatgctccaggcccatcgtctgcaccagctggccggccagctggtgcagacgatgggcctggagcatagcg

SEQ ID NO: 374 - DNA, 62 bp, Artificial Sequence
  Primer
gctccgcgcccatcacctgcaccagctggccggccagctggtgcaggtgatgggcgcggagc

SEQ ID NO: 375 - DNA, 62 bp, Artificial Sequence
  Primer
gctccgcgcccatcagctgcaccagctggccggccagctggtgcagctgatgggcgcggagc

SEQ ID NO: 376 - DNA, 62 bp, Artificial Sequence
  Primer
gctccgcgcccatcgtatccaccagctggccggccagctggtggatacgatgggcgcggagc

SEQ ID NO: 377 - DNA, 62 bp, Artificial Sequence
  Primer
gctccgcgcccatcgtgtgcaccagctggccggccagctggtgcacacgatgggcgcggagc

SEQ ID NO: 378 - DNA, 80 bp, Artificial Sequence
  Primer
gctccgcgcccatcgtctgcaccagatcgcctttgacaccggtgtcaaaggcgatctggtgcagacgatgggcgcggagc

SEQ ID NO: 379 - DNA, 74 bp, Artificial Sequence
  Primer
ccgcgcccatcgtctgcaccaggtggcctttgacaccggtgtcaaaggccacctggtgcagacgatgggcgcgg

SEQ ID NO: 380 - DNA, 78 bp, Artificial Sequence
  Primer
gcgcccatcgtctgcaccagctggccatcgacacctaccggtaggtgtcgatggccagctggtgcagacgatgggcgc

SEQ ID NO: 381 - DNA, 78 bp, Artificial Sequence
  Primer
gcgcccatcgtctgcaccagctggccgtggacacctaccggtaggtgtccacggccagctggtgcagacgatgggcgc

SEQ ID NO: 382 - DNA, 78 bp, Artificial Sequence
  Primer
cccatcgtctgcaccagctggcctttaacacctaccaggcctggtaggtgttaaaggccagctggtgcagacgatggg

SEQ ID NO: 383 - DNA, 68 bp, Artificial Sequence
  Primer
cgtctgcaccagctggcctttcagacctaccaggcctggtaggtctgaaaggccagctggtgcagacg

SEQ ID NO: 384 - DNA, 70 bp, Artificial Sequence
  Primer
gcaccagctggcctttgacacccaccaggagtttgcaaactcctggtgggtgtcaaaggccagctggtgc

SEQ ID NO: 385 - DNA, 70 bp, Artificial Sequence
  Primer
gcaccagctggcctttgacaccatccaggagtttgcaaactcctggatggtgtcaaaggccagctggtgc

SEQ ID NO: 386 - DNA, 80 bp, Artificial Sequence
  Primer
ccagctggcctttgacacctaccagcagtttgaagaagccggcttcttcaaactgctggtaggtgtcaaaggccagctgg

SEQ ID NO: 387 - DNA, 80 bp, Artificial Sequence
  Primer
ccagctggcctttgacacctaccagcactttgaagaagccggcttcttcaaagtgctggtaggtgtcaaaggccagctgg

SEQ ID NO: 388 - DNA, 80 bp, Artificial Sequence
  Primer
ccagctggcctttgacacctaccagaactttgaagaagccggcttcttcaaagttctggtaggtgtcaaaggccagctgg

SEQ ID NO: 389 - DNA, 62 bp, Artificial Sequence
  Primer
cctaccaggagatcgaagaagcctatatcccgggatataggcttcttcgatctcctggtagg

SEQ ID NO: 390 - DNA, 62 bp, Artificial Sequence
  Primer
cctaccaggaggtggaagaagcctatatcccgggatataggcttcttccacctcctggtagg

SEQ ID NO: 391 - DNA, 62 bp, Artificial Sequence
  Primer
cctaccaggagtttcaggaagcctatatcccgggatataggcttcctgaaactcctggtagg

SEQ ID NO: 392 - DNA, 62 bp, Artificial Sequence
  Primer
cctaccaggagtttcacgaagcctatatcccgggatataggcttcgtgaaactcctggtagg

SEQ ID NO: 393 - DNA, 70 bp, Artificial Sequence
  Primer
gacacctaccaggagtttaacgaagcctatatcccgggatataggcttcgttaaactcctggtaggtgtc

SEQ ID NO: 394 - DNA, 62 bp, Artificial Sequence
  Primer
cctaccaggagtttgaacaggcctatatcccgggatataggcctgttcaaactcctggtagg

SEQ ID NO: 395 - DNA, 62 bp, Artificial Sequence
  Primer
cctaccaggagtttgaacacgcctatatcccgggatataggcgtgttcaaactcctggtagg

SEQ ID NO: 396 - DNA, 70 bp, Artificial Sequence
  Primer
gacacctaccaggagtttgaaaacgcctatatcccgggatataggcgttttcaaactcctggtaggtgtc

SEQ ID NO: 397 - DNA, 64 bp, Artificial Sequence
  Primer
ccaggagtttgaagaagcccacatcccaaaggcctttgggatgtgggcttcttcaaactcctgg

SEQ ID NO: 398 - DNA, 64 bp, Artificial Sequence
  Primer
ccaggagtttgaagaagccatcatcccaaaggcctttgggatgatggcttcttcaaactcctgg

SEQ ID NO: 399 - DNA, 80 bp, Artificial Sequence
  Primer
ccaggagtttgaagaagcctatatcgccaaggaacagaagcttctgttccttggcgatataggcttcttcaaactcctgg

SEQ ID NO: 400 - DNA, 80 bp, Artificial Sequence
  Primer
ccaggagtttgaagaagcctatatcagcaaggaacagaagcttctgttccttgctgatataggcttcttcaaactcctgg

SEQ ID NO: 401 - DNA, 78 bp, Artificial Sequence
  Primer
gcctatatcccaaacgaacagaagtattcattcctgcagctgcaggaatgaatacttctgttcgtttgggatataggc

SEQ ID NO: 402 - DNA, 78 bp, Artificial Sequence
  Primer
gcctatatcccacaggaacagaagtattcattcctgcagctgcaggaatgaatacttctgttcctgtgggatataggc

SEQ ID NO: 403 - DNA, 78 bp, Artificial Sequence
  Primer
gcctatatcccaaagcagcagaagtattcattcctgcagctgcaggaatgaatacttctgctgctttgggatataggc

SEQ ID NO: 404 - DNA, 78 bp, Artificial Sequence
  Primer
gcctatatcccaaagcaccagaagtattcattcctgcagctgcaggaatgaatacttctggtgctttgggatataggc

SEQ ID NO: 405 - DNA, 78 bp, Artificial Sequence
  Primer
gcctatatcccaaagaaccagaagtattcattcctgcagctgcaggaatgaatacttctggttctttgggatataggc

SEQ ID NO: 406 - DNA, 76 bp, Artificial Sequence
  Primer
cccaaaggaacagaactattcattcctgcagaacccccgggggttctgcaggaatgaatagttctgttcctttggg

SEQ ID NO: 407 - DNA, 76 bp, Artificial Sequence
  Primer
cccaaaggaacagcagtattcattcctgcagaacccccgggggttctgcaggaatgaatactgctgttcctttggg

SEQ ID NO: 408 - DNA, 74 bp, Artificial Sequence
  Primer
ggaacagaagcactcattcctgcagaacccccagaccggtctgggggttctgcaggaatgagtgcttctgttcc

SEQ ID NO: 409 - DNA, 74 bp, Artificial Sequence
  Primer
ggaacagaagatctcattcctgcagaacccccagaccggtctgggggttctgcaggaatgagatcttctgttcc

SEQ ID NO: 410 - DNA, 70 bp, Artificial Sequence
  Primer
gaagtattcaatcctgcagaacccccagacctcccgggaggtctgggggttctgcaggattgaatacttc

SEQ ID NO: 411 - DNA, 70 bp, Artificial Sequence
  Primer
gaagtattcagtgctgcagaacccccagacctcccgggaggtctgggggttctgcagcactgaatacttc

SEQ ID NO: 412 - DNA, 64 bp, Artificial Sequence
  Primer
gtattcattcatccagaacccccagacctcccgggaggtctgggggttctggatgaatgaatac

SEQ ID NO: 413 - DNA, 64 bp, Artificial Sequence
  Primer
gtattcattcgtgcagaacccccagacctcccgggaggtctgggggttctgcacgaatgaatac

SEQ ID NO: 414 - DNA, 62 bp, Artificial Sequence
  Primer
cctgcagaacgcccagacctccctctgtttcgaaacagagggaggtctgggcgttctgcagg

SEQ ID NO: 415 - DNA, 62 bp, Artificial Sequence
  Primer
cctgcagaacagccagacctccctctgtttcgaaacagagggaggtctggctgttctgcagg

SEQ ID NO: 416 - DNA, 70 bp, Artificial Sequence
  Primer
cctgcagaacccccagacctccatctgtttctcagctgagaaacagatggaggtctgggggttctgcagg

SEQ ID NO: 417 - DNA, 60 bp, Artificial Sequence
  Primer
cccccagacctccgtgtgtttctcagagtcgactctgagaaacacacggaggtctggggg

SEQ ID NO: 418 - DNA, 74 bp, Artificial Sequence
  Primer
cccccagacctccctctgtatctcagagtctattccgcggaatagactctgagatacagagggaggtctggggg

SEQ ID NO: 419 - DNA, 74 bp, Artificial Sequence
  Primer
cccccagacctccctctgtgtgtcagagtctattccgcggaatagactctgacacacagagggaggtctggggg

SEQ ID NO: 420 - DNA, 78 bp, Artificial Sequence
  Primer
cccccagacctccctctgtttctcacagtctattccgacgtcggaatagactgtgagaaacagagggaggtctggggg

SEQ ID NO: 421 - DNA, 78 bp, Artificial Sequence
  Primer
cccccagacctccctctgtttctcacactctattccgacgtcggaatagagtgtgagaaacagagggaggtctggggg

SEQ ID NO: 422 - DNA, 78 bp, Artificial Sequence
  Primer
cccccagacctccctctgtttctcaaactctattccgacgtcggaatagagtttgagaaacagagggaggtctggggg

SEQ ID NO: 423 - DNA, 66 bp, Artificial Sequence
  Primer
cagagtctattgccacaccctccaacagggaggcctccctgttggagggtgtggcaatagactctg

SEQ ID NO: 424 - DNA, 66 bp, Artificial Sequence
  Primer
cagagtctattagcacaccctccaacagggaggcctccctgttggagggtgtgctaatagactctg

SEQ ID NO: 425 - DNA, 62 bp, Artificial Sequence
  Primer
gagtctattccgacagcctccaacagggaggcctccctgttggaggctgtcggaatagactc

SEQ ID NO: 426 - DNA, 62 bp, Artificial Sequence
  Primer
gagtctattccgacaagctccaacagggaggcctccctgttggagcttgtcggaatagactc

SEQ ID NO: 427 - DNA, 62 bp, Artificial Sequence
  Primer
ccgacaccctccaaccacgaggaaacacaacgttgtgtttcctcgtggttggagggtgtcgg

SEQ ID NO: 428 - DNA, 62 bp, Artificial Sequence
  Primer
ccgacaccctccaaccaggaggaaacacaacgttgtgtttcctcctggttggagggtgtcgg

SEQ ID NO: 429 - DNA, 62 bp, Artificial Sequence
  Primer
ccgacaccctccaacaggcaggaaacacaacgttgtgtttcctgcctgttggagggtgtcgg

SEQ ID NO: 430 - DNA, 62 bp, Artificial Sequence
  Primer
ccgacaccctccaacaggcacgaaacacaacgttgtgtttcgtgcctgttggagggtgtcgg

SEQ ID NO: 431 - DNA, 62 bp, Artificial Sequence
  Primer
ccgacaccctccaacaggaacgaaacacaacgttgtgtttcgttcctgttggagggtgtcgg

SEQ ID NO: 432 - DNA, 78 bp, Artificial Sequence
  Primer
ccgacaccctccaacagggagcagacacaacagaaatccggatttctgttgtgtctgctccctgttggagggtgtcgg

SEQ ID NO: 433 - DNA, 78 bp, Artificial Sequence
  Primer
ccgacaccctccaacagggagcacacacaacagaaatccggatttctgttgtgtgtgctccctgttggagggtgtcgg

SEQ ID NO: 434 - DNA, 78 bp, Artificial Sequence
  Primer
ccgacaccctccaacagggagaacacacaacagaaatccggatttctgttgtgtgttctccctgttggagggtgtcgg

SEQ ID NO: 435 - DNA, 80 bp, Artificial Sequence
  Primer
ggaggaaacacaacagaactccaacctagagctgctccgcgcggagcagctctaggttggagttctgttgtgtttcctcc

SEQ ID NO: 436 - DNA, 80 bp, Artificial Sequence
  Primer
ggaggaaacacaacagcagtccaacctagagctgctccgcgcggagcagctctaggttggactgctgttgtgtttcctcc

SEQ ID NO: 437 - DNA, 76 bp, Artificial Sequence
  Primer
gaaatccaacatcgagctgctccgcatctccctgctgcgcagcagggagatgcggagcagctcgatgttggatttc

SEQ ID NO: 438 - DNA, 76 bp, Artificial Sequence
  Primer
gaaatccaacgtggagctgctccgcatctccctgctgcgcagcagggagatgcggagcagctccacgttggatttc

SEQ ID NO: 439 - DNA, 76 bp, Artificial Sequence
  Primer
gaaatccaacctacagctgctccgcatctccctgctgcgcagcagggagatgcggagcagctgtaggttggatttc

SEQ ID NO: 440 - DNA, 76 bp, Artificial Sequence
  Primer
gaaatccaacctacacctgctccgcatctccctgctgcgcagcagggagatgcggagcaggtgtaggttggatttc

SEQ ID NO: 441 - DNA, 76 bp, Artificial Sequence
  Primer
gaaatccaacctaaacctgctccgcatctccctgctgcgcagcagggagatgcggagcaggtttaggttggatttc

SEQ ID NO: 442 - DNA, 66 bp, Artificial Sequence
  Primer
ccaacctagagatcctccgcatctccctgctgcgcagcagggagatgcggaggatctctaggttgg

SEQ ID NO: 443 - DNA, 65 bp, Artificial Sequence
  Primer
ccaacctagaggtgctccgcatctccctgctgcgagcagggagatgcggagcacctctaggttgg

SEQ ID NO: 444 - DNA, 62 bp, Artificial Sequence
  Primer
cctagagctgatccgcatctccctgctgctcgagcagcagggagatgcggatcagctctagg

SEQ ID NO: 445 - DNA, 62 bp, Artificial Sequence
  Primer
cctagagctggtgcgcatctccctgctgctcgagcagcagggagatgcgcaccagctctagg

SEQ ID NO: 446 - DNA, 62 bp, Artificial Sequence
  Primer
cctagagctgctccacatctccctgctgctcgagcagcagggagatgtggagcagctctagg

SEQ ID NO: 447 - DNA, 62 bp, Artificial Sequence
  Primer
cctagagctgctccagatctccctgctgctcgagcagcagggagatctggagcagctctagg

SEQ ID NO: 448 - DNA, 78 bp, Artificial Sequence
  Primer
ccgcatctccatcctgctcatccagtcgtggctggagccggctccagccacgactggatgagcaggatggagatgcgg

SEQ ID NO: 449 - DNA, 77 bp, Artificial Sequence
  Primer
ccgcatctccgtgctgctcatccagtcgtggctggagccgctccagccacgactggatgagcagcacggagatgcgg

SEQ ID NO: 450 - DNA, 80 bp, Artificial Sequence
  Primer
cgcatctccctgatcctcatccagtcgtggctggagcccgcgggctccagccacgactggatgaggatcagggagatgcg

SEQ ID NO: 451 - DNA, 79 bp, Artificial Sequence
  Primer
cgcatctccctggtgctcatccagtcgtggctggagcccggggctccagccacgactggatgagcaccagggagatgcg

SEQ ID NO: 452 - DNA, 75 bp, Artificial Sequence
  Primer
ctccctgctgatcatccagtcgtggctggagcccgtgccacgggctccagccacgactggatgatcagcagggag

SEQ ID NO: 453 - DNA, 70 bp, Artificial Sequence
  Primer
ctccctgctggtgatccagtcgtggctggagcccgcgggctccagccacgactggatcaccagcagggag

SEQ ID NO: 454 - DNA, 66 bp, Artificial Sequence
  Primer
ccctgctgctcatccagtcgcacctggagcccgcgggctccaggtgcgactggatgagcagcaggg

SEQ ID NO: 455 - DNA, 66 bp, Artificial Sequence
  Primer
ccctgctgctcatccagtcgagcctggagcccgcgggctccaggctcgactggatgagcagcaggg

SEQ ID NO: 456 - DNA, 72 bp, Artificial Sequence
  Primer
ccctgctgctcatccagtcgtggatcgagcccgtgcgcacgggctcgatccacgactggatgagcagcaggg

SEQ ID NO: 457 - DNA, 72 bp, Artificial Sequence
  Primer
ccctgctgctcatccagtcgtgggtggagcccgtgcgcacgggctccacccacgactggatgagcagcaggg

SEQ ID NO: 458 - DNA, 62 bp, Artificial Sequence
  Primer
gtcgtggctgcagcccgtgcagttcctcaggcctgaggaactgcacgggctgcagccacgac

SEQ ID NO: 459 - DNA, 62 bp, Artificial Sequence
  Primer
gtcgtggctgcaccccgtgcagttcctcaggcctgaggaactgcacggggtgcagccacgac

SEQ ID NO: 460 - DNA, 68 bp, Artificial Sequence
  Primer
ccagtcgtggctgaaccccgtgcagttcctcaggcctgaggaactgcacggggttcagccacgactgg

SEQ ID NO: 461 - DNA, 62 bp, Artificial Sequence
  Primer
cgtggctggaggccgtgcagttcctcaggagctcctgaggaactgcacggcctccagccacg

SEQ ID NO: 462 - DNA, 68 bp, Artificial Sequence
  Primer
ccagtcgtggctggagagcgtgcagttcctcaggcctgaggaactgcacgctctccagccacgactgg

SEQ ID NO: 463 - DNA, 60 bp, Artificial Sequence
  Primer
ggctggagcccgtgcagatcctcaggagtgcactcctgaggatctgcacgggctccagcc

SEQ ID NO: 464 - DNA, 60 bp, Artificial Sequence
  Primer
ggctggagcccgtgcaggtgctcaggagtgcactcctgagcacctgcacgggctccagcc

SEQ ID NO: 465 - DNA, 76 bp, Artificial Sequence
  Primer
ggctggagcccgtgcagttcatcaggagtgtcttcgccggcgaagacactcctgatgaactgcacgggctccagcc

SEQ ID NO: 466 - DNA, 76 bp, Artificial Sequence
  Primer
ggctggagcccgtgcagttcgtgaggagtgtcttcgccggcgaagacactcctcacgaactgcacgggctccagcc

SEQ ID NO: 467 - DNA, 76 bp, Artificial Sequence
  Primer
ggctggagcccgtgcagttcctccacagtgtcttcgccggcgaagacactgtggaggaactgcacgggctccagcc

SEQ ID NO: 468 - DNA, 76 bp, Artificial Sequence
  Primer
ggctggagcccgtgcagttcctccagagtgtcttcgccggcgaagacactctggaggaactgcacgggctccagcc

SEQ ID NO: 469 - DNA, 80 bp, Artificial Sequence
  Primer
cctcaggagtgtcatcgccaacagcctggtgtacggcgccggcgccgtacaccaggctgttggcgatgacactcctgagg

SEQ ID NO: 470 - DNA, 74 bp, Artificial Sequence
  Primer
caggagtgtcgtggccaacagcctggtgtacggcgccggcgccgtacaccaggctgttggccacgacactcctg

SEQ ID NO: 471 - DNA, 68 bp, Artificial Sequence
  Primer
cgccaacagcatcgtgtacggcgcctctgacagcgctgtcagaggcgccgtacacgatgctgttggcg

SEQ ID NO: 472 - DNA, 62 bp, Artificial Sequence
  Primer
cgccaacagcgtggtgtacggcgcctctgacgtcagaggcgccgtacaccacgctgttggcg

SEQ ID NO: 473 - DNA, 62 bp, Artificial Sequence
  Primer
cgccaacagcctggtgcacggcgcctctgacgtcagaggcgccgtgcaccaggctgttggcg

SEQ ID NO: 474 - DNA, 62 bp, Artificial Sequence
  Primer
cgccaacagcctggtgatcggcgcctctgacgtcagaggcgccgatcaccaggctgttggcg

SEQ ID NO: 475 - DNA, 64 bp, Artificial Sequence
  Primer
cggcgcctctaacagcaacgtctatgacctccggaggtcatagacgttgctgttagaggcgccg

SEQ ID NO: 476 - DNA, 64 bp, Artificial Sequence
  Primer
cggcgcctctcagagcaacgtctatgacctccggaggtcatagacgttgctctgagaggcgccg

SEQ ID NO: 477 - DNA, 76 bp, Artificial Sequence
  Primer
cggcgcctctgacagcaacgtccacgacctcctaaaggcctttaggaggtcgtggacgttgctgtcagaggcgccg

SEQ ID NO: 478 - DNA, 76 bp, Artificial Sequence
  Primer
cggcgcctctgacagcaacgtcatcgacctcctaaaggcctttaggaggtcgatgacgttgctgtcagaggcgccg

SEQ ID NO: 479 - DNA, 76 bp, Artificial Sequence
  Primer
cggcgcctctgacagcaacgtctataacctcctaaaggcctttaggaggttatagacgttgctgtcagaggcgccg

SEQ ID NO: 480 - DNA, 76 bp, Artificial Sequence
  Primer
cggcgcctctgacagcaacgtctatcagctcctaaaggcctttaggagctgatagacgttgctgtcagaggcgccg

SEQ ID NO: 481 - DNA, 78 bp, Artificial Sequence
  Primer
gcgcctctgacagcaacgtctatgacatcctaaaggaccggtcctttaggatgtcatagacgttgctgtcagaggcgc

SEQ ID NO: 482 - DNA, 78 bp, Artificial Sequence
  Primer
gcgcctctgacagcaacgtctatgacgtgctaaaggaccggtcctttagcacgtcatagacgttgctgtcagaggcgc

SEQ ID NO: 483 - DNA, 68 bp, Artificial Sequence
  Primer
cgtctatgacctcatcaaggacctagaggaaggcgccttcctctaggtccttgatgaggtcatagacg

SEQ ID NO: 484 - DNA, 68 bp, Artificial Sequence
  Primer
cgtctatgacctcgtgaaggacctagaggaaggcgccttcctctaggtccttcacgaggtcatagacg

SEQ ID NO: 485 - DNA, 68 bp, Artificial Sequence
  Primer
cgtctatgacctcctaaacgacctagaggaaggcgccttcctctaggtcgtttaggaggtcatagacg

SEQ ID NO: 486 - DNA, 68 bp, Artificial Sequence
  Primer
cgtctatgacctcctacaggacctagaggaaggcgccttcctctaggtcctgtaggaggtcatagacg

SEQ ID NO: 487 - DNA, 62 bp, Artificial Sequence
  Primer
gacctcctaaagaacctagaggaaggcatccggatgccttcctctaggttctttaggaggtc

SEQ ID NO: 488 - DNA, 62 bp, Artificial Sequence
  Primer
gacctcctaaagcagctagaggaaggcatccggatgccttcctctagctgctttaggaggtc

SEQ ID NO: 489 - DNA, 62 bp, Artificial Sequence
  Primer
gacctcctaaaggacatcgaggaaggcatccggatgccttcctcgatgtcctttaggaggtc

SEQ ID NO: 490 - DNA, 62 bp, Artificial Sequence
  Primer
gacctcctaaaggacgtggaggaaggcatccggatgccttcctccacgtcctttaggaggtc

SEQ ID NO: 491 - DNA, 80 bp, Artificial Sequence
  Primer
cctaaaggacctacaggaaggcatccaaacgctgatggggccccatcagcgtttggatgccttcctgtaggtcctttagg

SEQ ID NO: 492 - DNA, 80 bp, Artificial Sequence
  Primer
cctaaaggacctacacgaaggcatccaaacgctgatggggccccatcagcgtttggatgccttcgtgtaggtcctttagg

SEQ ID NO: 493 - DNA, 80 bp, Artificial Sequence
  Primer
cctaaaggacctaaacgaaggcatccaaacgctgatggggccccatcagcgtttggatgccttcgtttaggtcctttagg

SEQ ID NO: 494 - DNA, 76 bp, Artificial Sequence
  Primer
ggacctagagcagggcatccaaacgctgatggggaggcgcctccccatcagcgtttggatgccctgctctaggtcc

SEQ ID NO: 495 - DNA, 76 bp, Artificial Sequence
  Primer
ggacctagagcacggcatccaaacgctgatggggaggcgcctccccatcagcgtttggatgccgtgctctaggtcc

SEQ ID NO: 496 - DNA, 76 bp, Artificial Sequence
  Primer
ggacctagagaacggcatccaaacgctgatggggaggcgcctccccatcagcgtttggatgccgttctctaggtcc

SEQ ID NO: 497 - DNA, 80 bp, Artificial Sequence
  Primer
gcatccaaacgatcatggggaggctggaagatggcagcccgggctgccatcttccagcctccccatgatcgtttggatgc

SEQ ID NO: 498 - DNA, 80 bp, Artificial Sequence
  Primer
gcatccaaacggtgatggggaggctggaagatggcagcccgggctgccatcttccagcctccccatcaccgtttggatgc

SEQ ID NO: 499 - DNA, 78 bp, Artificial Sequence
  Primer
ccaaacgctgatcgggaggctggaagatggcagcccccgcgggggctgccatcttccagcctcccgatcagcgtttgg

SEQ ID NO: 500 - DNA, 78 bp, Artificial Sequence
  Primer
ccaaacgctggtggggaggctggaagatggcagcccccgcgggggctgccatcttccagcctccccaccagcgtttgg

SEQ ID NO: 501 - DNA, 70 bp, Artificial Sequence
  Primer
cgctgatggggcacctggaagatggcagcccccggccgggggctgccatcttccaggtgccccatcagcg

SEQ ID NO: 502 - DNA, 70 bp, Artificial Sequence
  Primer
cgctgatggggcagctggaagatggcagcccccggccgggggctgccatcttccagctgccccatcagcg

SEQ ID NO: 503 - DNA, 70 bp, Artificial Sequence
  Primer
cgctgatggggaggatcgaagatggcagcccccggccgggggctgccatcttcgatcctccccatcagcg

SEQ ID NO: 504 - DNA, 70 bp, Artificial Sequence
  Primer
cgctgatggggagggtggaagatggcagcccccggccgggggctgccatcttccaccctccccatcagcg

SEQ ID NO: 505 - DNA, 70 bp, Artificial Sequence
  Primer
ggggaggctgcaggatggcagcccccggactgggcgcccagtccgggggctgccatcctgcagcctcccc

SEQ ID NO: 506 - DNA, 70 bp, Artificial Sequence
  Primer
ggggaggctgcacgatggcagcccccggactgggcgcccagtccgggggctgccatcgtgcagcctcccc

SEQ ID NO: 507 - DNA, 70 bp, Artificial Sequence
  Primer
ggggaggctgaacgatggcagcccccggactgggcgcccagtccgggggctgccatcgttcagcctcccc

SEQ ID NO: 508 - DNA, 70 bp, Artificial Sequence
  Primer
ggggaggctggaaaacggcagcccccggactgggcgcccagtccgggggctgccgttttccagcctcccc

SEQ ID NO: 509 - DNA, 70 bp, Artificial Sequence
  Primer
ggggaggctggaacagggcagcccccggactgggcgcccagtccgggggctgccctgttccagcctcccc

SEQ ID NO: 510 - DNA, 70 bp, Artificial Sequence
  Primer
ggggaggctggaagatggcagcgcccggactgggcgcccagtccgggcgctgccatcttccagcctcccc

SEQ ID NO: 511 - DNA, 70 bp, Artificial Sequence
  Primer
ggggaggctggaagatggcagcagccggactgggcgcccagtccggctgctgccatcttccagcctcccc

SEQ ID NO: 512 - DNA, 80 bp, Artificial Sequence
  Primer
ggggaggctggaagatggcagcccccacactgggcagatcgatctgcccagtgtgggggctgccatcttccagcctcccc

SEQ ID NO: 513 - DNA, 80 bp, Artificial Sequence
  Primer
ggggaggctggaagatggcagcccccagactgggcagatcgatctgcccagtctgggggctgccatcttccagcctcccc

SEQ ID NO: 514 - DNA, 78 bp, Artificial Sequence
  Primer
ggcagcccccggactgggcagatcatcaagcagacctacgtaggtctgcttgatgatctgcccagtccgggggctgcc

SEQ ID NO: 515 - DNA, 78 bp, Artificial Sequence
  Primer
ggcagcccccggactgggcagatcgtgaagcagacctacgtaggtctgcttcacgatctgcccagtccgggggctgcc

SEQ ID NO: 516 - DNA, 76 bp, Artificial Sequence
  Primer
gcccccggactgggcagatcttcaaccagacctacagcgctgtaggtctggttgaagatctgcccagtccgggggc

SEQ ID NO: 517 - DNA, 76 bp, Artificial Sequence
  Primer
gcccccggactgggcagatcttccagcagacctacagcgctgtaggtctgctggaagatctgcccagtccgggggc

SEQ ID NO: 518 - DNA, 78 bp, Artificial Sequence
  Primer
ggactgggcagatcttcaagcagacccacagcaagttcgcgaacttgctgtgggtctgcttgaagatctgcccagtcc

SEQ ID NO: 519 - DNA, 78 bp, Artificial Sequence
  Primer
ggactgggcagatcttcaagcagaccatcagcaagttcgcgaacttgctgatggtctgcttgaagatctgcccagtcc

SEQ ID NO: 520 - DNA, 60 bp, Artificial Sequence
  Primer
gcagacctacagcaacttcgacacaaactcgagtttgtgtcgaagttgctgtaggtctgc

SEQ ID NO: 521 - DNA, 60 bp, Artificial Sequence
  Primer
gcagacctacagccagttcgacacaaactcgagtttgtgtcgaactggctgtaggtctgc

SEQ ID NO: 522 - DNA, 80 bp, Artificial Sequence
  Primer
cctacagcaagatcgacacaaactcacacaacgatgacgcgcgtcatcgttgtgtgagtttgtgtcgatcttgctgtagg

SEQ ID NO: 523 - DNA, 60 bp, Artificial Sequence
  Primer
gcagacctacagcaaggtggacacaaactcgagtttgtgtccaccttgctgtaggtctgc

SEQ ID NO: 524 - DNA, 80 bp, Artificial Sequence
  Primer
cctacagcaagttcaacacaaactcacacaacgatgacgcgcgtcatcgttgtgtgagtttgtgttgaacttgctgtagg

SEQ ID NO: 525 - DNA, 72 bp, Artificial Sequence
  Primer
cagcaagttccagacaaactcacacaacgatgacgcgcgtcatcgttgtgtgagtttgtctggaacttgctg

SEQ ID NO: 526 - DNA, 76 bp, Artificial Sequence
  Primer
ctcacacaacaacgacgcactactcaagaactacgggcgcccgtagttcttgagtagtgcgtcgttgttgtgtgag

SEQ ID NO: 527 - DNA, 76 bp, Artificial Sequence
  Primer
ctcacacaaccaggacgcactactcaagaactacgggcgcccgtagttcttgagtagtgcgtcctggttgtgtgag

SEQ ID NO: 528 - DNA, 78 bp, Artificial Sequence
  Primer
cacacaacgataacgcactactcaagaactacgggctgcgcagcccgtagttcttgagtagtgcgttatcgttgtgtg

SEQ ID NO: 529 - DNA, 78 bp, Artificial Sequence
  Primer
cacacaacgatcaggcactactcaagaactacgggctgcgcagcccgtagttcttgagtagtgcctgatcgttgtgtg

SEQ ID NO: 530 - DNA, 64 bp, Artificial Sequence
  Primer
cgatgacgcaatcctcaagaactacgggctgcgcagcccgtagttcttgaggattgcgtcatcg

SEQ ID NO: 531 - DNA, 64 bp, Artificial Sequence
  Primer
cgatgacgcagtgctcaagaactacgggctgcgcagcccgtagttcttgagcactgcgtcatcg

SEQ ID NO: 532 - DNA, 64 bp, Artificial Sequence
  Primer
cgatgacgcactaatcaagaactacgggctgcgcagcccgtagttcttgattagtgcgtcatcg

SEQ ID NO: 533 - DNA, 64 bp, Artificial Sequence
  Primer
cgatgacgcactagtgaagaactacgggctgcgcagcccgtagttcttcactagtgcgtcatcg

SEQ ID NO: 534 - DNA, 60 bp, Artificial Sequence
  Primer
gacgcactactcaacaactacgggctgctcgagcagcccgtagttgttgagtagtgcgtc

SEQ ID NO: 535 - DNA, 60 bp, Artificial Sequence
  Primer
gacgcactactccagaactacgggctgctcgagcagcccgtagttctggagtagtgcgtc

SEQ ID NO: 536 - DNA, 68 bp, Artificial Sequence
  Primer
cgcactactcaagaaccacgggctgctctactgcgcagtagagcagcccgtggttcttgagtagtgcg

SEQ ID NO: 537 - DNA, 68 bp, Artificial Sequence
  Primer
cgcactactcaagaacatcgggctgctctactgcgcagtagagcagcccgatgttcttgagtagtgcg

SEQ ID NO: 538 - DNA, 64 bp, Artificial Sequence
  Primer
gaactacgggatcctctactgcttcaggaaggccttcctgaagcagtagaggatcccgtagttc

SEQ ID NO: 539 - DNA, 64 bp, Artificial Sequence
  Primer
gaactacggggtgctctactgcttcaggaaggccttcctgaagcagtagagcaccccgtagttc

SEQ ID NO: 540 - DNA, 62 bp, Artificial Sequence
  Primer
ctacgggctgatctactgcttcaggaaggacgtccttcctgaagcagtagatcagcccgtag

SEQ ID NO: 541 - DNA, 62 bp, Artificial Sequence
  Primer
ctacgggctggtgtactgcttcaggaaggacgtccttcctgaagcagtacaccagcccgtag

SEQ ID NO: 542 - DNA, 64 bp, Artificial Sequence
  Primer
cgggctgctccactgcttcaggaaggacatggccatgtccttcctgaagcagtggagcagcccg

SEQ ID NO: 543 - DNA, 64 bp, Artificial Sequence
  Primer
cgggctgctcatctgcttcaggaaggacatggccatgtccttcctgaagcagatgagcagcccg

SEQ ID NO: 544 - DNA, 64 bp, Artificial Sequence
  Primer
cgggctgctctactgcatcaggaaggacatggccatgtccttcctgatgcagtagagcagcccg

SEQ ID NO: 545 - DNA, 64 bp, Artificial Sequence
  Primer
cgggctgctctactgcgtgaggaaggacatggccatgtccttcctcacgcagtagagcagcccg

SEQ ID NO: 546 - DNA, 64 bp, Artificial Sequence
  Primer
cgggctgctctactgcttccacaaggacatggccatgtccttgtggaagcagtagagcagcccg

SEQ ID NO: 547 - DNA, 64 bp, Artificial Sequence
  Primer
cgggctgctctactgcttccagaaggacatggccatgtccttctggaagcagtagagcagcccg

SEQ ID NO: 548 - DNA, 76 bp, Artificial Sequence
  Primer
cgggctgctctactgcttcaggaacgacatggacaaggccttgtccatgtcgttcctgaagcagtagagcagcccg

SEQ ID NO: 549 - DNA, 76 bp, Artificial Sequence
  Primer
cgggctgctctactgcttcaggcaggacatggacaaggccttgtccatgtcctgcctgaagcagtagagcagcccg

SEQ ID NO: 550 - DNA, 76 bp, Artificial Sequence
  Primer
cgggctgctctactgcttcaggaagaacatggacaaggccttgtccatgttcttcctgaagcagtagagcagcccg

SEQ ID NO: 551 - DNA, 76 bp, Artificial Sequence
  Primer
cgggctgctctactgcttcaggaagcagatggacaaggccttgtccatctgcttcctgaagcagtagagcagcccg

SEQ ID NO: 552 - DNA, 74 bp, Artificial Sequence
  Primer
caggaaggacatcgacaaggtcgagacattcctgcgcgcgcaggaatgtctcgaccttgtcgatgtccttcctg

SEQ ID NO: 553 - DNA, 74 bp, Artificial Sequence
  Primer
caggaaggacgtggacaaggtcgagacattcctgcgcgcgcaggaatgtctcgaccttgtccacgtccttcctg

SEQ ID NO: 554 - DNA, 70 bp, Artificial Sequence
  Primer
ggaaggacatgaacaaggtcgagacattcctgcgcgcgcaggaatgtctcgaccttgttcatgtccttcc

SEQ ID NO: 555 - DNA, 70 bp, Artificial Sequence
  Primer
ggaaggacatgcagaaggtcgagacattcctgcgcgcgcaggaatgtctcgaccttctgcatgtccttcc

SEQ ID NO: 556 - DNA, 62 bp, Artificial Sequence
  Primer
ggacatggacaacgtcgagacattcctgcgcgcgcaggaatgtctcgacgttgtccatgtcc

SEQ ID NO: 557 - DNA, 62 bp, Artificial Sequence
  Primer
ggacatggaccaggtcgagacattcctgcgcgcgcaggaatgtctcgacctggtccatgtcc

SEQ ID NO: 558 - DNA, 78 bp, Artificial Sequence
  Primer
ggacaaggtccagacattcctgcgcatcgtgcagtgccgcggcactgcacgatgcgcaggaatgtctggaccttgtcc

SEQ ID NO: 559 - DNA, 78 bp, Artificial Sequence
  Primer
ggacaaggtccacacattcctgcgcatcgtgcagtgccgcggcactgcacgatgcgcaggaatgtgtggaccttgtcc

SEQ ID NO: 560 - DNA, 78 bp, Artificial Sequence
  Primer
ggacaaggtcaacacattcctgcgcatcgtgcagtgccgcggcactgcacgatgcgcaggaatgtgttgaccttgtcc

SEQ ID NO: 561 - DNA, 68 bp, Artificial Sequence
  Primer
ggtcgagacaatcctgcgcatcgtgcagtgccgcgcggcactgcacgatgcgcaggattgtctcgacc

SEQ ID NO: 562 - DNA, 68 bp, Artificial Sequence
  Primer
ggtcgagacagtgctgcgcatcgtgcagtgccgcgcggcactgcacgatgcgcagcactgtctcgacc

SEQ ID NO: 563 - DNA, 68 bp, Artificial Sequence
  Primer
ggtcgagacattcatccgcatcgtgcagtgccgcgcggcactgcacgatgcggatgaatgtctcgacc

SEQ ID NO: 564 - DNA, 68 bp, Artificial Sequence
  Primer
ggtcgagacattcgtgcgcatcgtgcagtgccgcgcggcactgcacgatgcgcacgaatgtctcgacc

SEQ ID NO: 565 - DNA, 68 bp, Artificial Sequence
  Primer
ggtcgagacattcctgcacatcgtgcagtgccgcgcggcactgcacgatgtgcaggaatgtctcgacc

SEQ ID NO: 566 - DNA, 68 bp, Artificial Sequence
  Primer
ggtcgagacattcctgcagatcgtgcagtgccgcgcggcactgcacgatctgcaggaatgtctcgacc

SEQ ID NO: 567 - DNA, 62 bp, Artificial Sequence
  Primer
gcgcatcgtgcagtgccactctgtggagggcgccctccacagagtggcactgcacgatgcgc

SEQ ID NO: 568 - DNA, 62 bp, Artificial Sequence
  Primer
gcgcatcgtgcagtgccagtctgtggagggcgccctccacagactggcactgcacgatgcgc

SEQ ID NO: 569 - DNA, 62 bp, Artificial Sequence
  Primer
gcagtgccgctctgtgcagggcagctgtggcgccacagctgccctgcacagagcggcactgc

SEQ ID NO: 570 - DNA, 62 bp, Artificial Sequence
  Primer
gcagtgccgctctgtgcacggcagctgtggcgccacagctgccgtgcacagagcggcactgc

SEQ ID NO: 571 - DNA, 62 bp, Artificial Sequence
  Primer
gcagtgccgctctgtgaacggcagctgtggcgccacagctgccgttcacagagcggcactgc

SEQ ID NO: 572 - DNA, 71 bp, Artificial Sequence
  Primer
gccgctctgtggagggcagctgtggcatctagagggcccgccacccgggcagctagatgccacagctgccc

SEQ ID NO: 573 - DNA, 71 bp, Artificial Sequence
  Primer
gccgctctgtggagggcagctgtggcgtgtagagggcccgccacccgggcagctacacgccacagctgccc

SEQ ID NO: 574 - DNA, 80 bp, Artificial Sequence
  Primer
ggcagtgccttcccaaccattcccgagtccaggctttttgcaaaaagcctggactcgggaatggttgggaaggcactgcc

SEQ ID NO: 575 - DNA, 80 bp, Artificial Sequence
  Primer
ggcagtgccttcccaaccattcccgactccaggctttttgcaaaaagcctggagtcgggaatggttgggaaggcactgcc

SEQ ID NO: 576 - DNA, 80 bp, Artificial Sequence
  Primer
ggcagtgccttcccaaccattcccaagtccaggctttttgcaaaaagcctggacttgggaatggttgggaaggcactgcc

SEQ ID NO: 577 - DNA, 80 bp, Artificial Sequence
  Primer
ggcagtgccttcccaaccattcccaggtccaggctttttgcaaaaagcctggacctgggaatggttgggaaggcactgcc

SEQ ID NO: 578 - DNA, 80 bp, Artificial Sequence
  Primer
ggcagtgccttcccaaccattcccaactccaggctttttgcaaaaagcctggagttgggaatggttgggaaggcactgcc

SEQ ID NO: 579 - DNA, 80 bp, Artificial Sequence
  Primer
ggcagtgccttcccaaccattccccagtccaggctttttgcaaaaagcctggactggggaatggttgggaaggcactgcc

SEQ ID NO: 580 - DNA, 80 bp, Artificial Sequence
  Primer
ggcagtgccttcccaaccattcccagctccaggctttttgcaaaaagcctggagctgggaatggttgggaaggcactgcc

SEQ ID NO: 581 - DNA, 80 bp, Artificial Sequence
  Primer
ggcagtgccttcccaaccattcccacctccaggctttttgcaaaaagcctggaggtgggaatggttgggaaggcactgcc

SEQ ID NO: 582 - DNA, 80 bp, Artificial Sequence
  Primer
cccttatccagggagtttgacaacgctatgctccgcgcccgggcgcggagcatagcgttgtcaaactccctggataaggg

SEQ ID NO: 583 - DNA, 80 bp, Artificial Sequence
  Primer
cccttatccagggactttgacaacgctatgctccgcgcccgggcgcggagcatagcgttgtcaaagtccctggataaggg

SEQ ID NO: 584 - DNA, 80 bp, Artificial Sequence
  Primer
cccttatccaggaagtttgacaacgctatgctccgcgcccgggcgcggagcatagcgttgtcaaacttcctggataaggg

SEQ ID NO: 585 - DNA, 80 bp, Artificial Sequence
  Primer
cccttatccaggaggtttgacaacgctatgctccgcgcccgggcgcggagcatagcgttgtcaaacctcctggataaggg

SEQ ID NO: 586 - DNA, 80 bp, Artificial Sequence
  Primer
cccttatccaggaactttgacaacgctatgctccgcgcccgggcgcggagcatagcgttgtcaaagttcctggataaggg

SEQ ID NO: 587 - DNA, 80 bp, Artificial Sequence
  Primer
cccttatccaggcagtttgacaacgctatgctccgcgcccgggcgcggagcatagcgttgtcaaactgcctggataaggg

SEQ ID NO: 588 - DNA, 80 bp, Artificial Sequence
  Primer
cccttatccaggagctttgacaacgctatgctccgcgcccgggcgcggagcatagcgttgtcaaagctcctggataaggg

SEQ ID NO: 589 - DNA, 80 bp, Artificial Sequence
  Primer
cccttatccaggacctttgacaacgctatgctccgcgcccgggcgcggagcatagcgttgtcaaaggtcctggataaggg

SEQ ID NO: 590 - DNA, 66 bp, Artificial Sequence
  Primer
ccaggctttttgacaacgagatgctccgcgcccgggcgcggagcatctcgttgtcaaaaagcctgg

SEQ ID NO: 591 - DNA, 66 bp, Artificial Sequence
  Primer
ccaggctttttgacaacgacatgctccgcgcccgggcgcggagcatgtcgttgtcaaaaagcctgg

SEQ ID NO: 592 - DNA, 66 bp, Artificial Sequence
  Primer
ccaggctttttgacaacaagatgctccgcgcccgggcgcggagcatcttgttgtcaaaaagcctgg

SEQ ID NO: 593 - DNA, 66 bp, Artificial Sequence
  Primer
ccaggctttttgacaacaggatgctccgcgcccgggcgcggagcatcctgttgtcaaaaagcctgg

SEQ ID NO: 594 - DNA, 66 bp, Artificial Sequence
  Primer
ccaggctttttgacaacaacatgctccgcgcccgggcgcggagcatgttgttgtcaaaaagcctgg

SEQ ID NO: 595 - DNA, 66 bp, Artificial Sequence
  Primer
ccaggctttttgacaaccagatgctccgcgcccgggcgcggagcatctggttgtcaaaaagcctgg

SEQ ID NO: 596 - DNA, 66 bp, Artificial Sequence
  Primer
ccaggctttttgacaacagcatgctccgcgcccgggcgcggagcatgctgttgtcaaaaagcctgg

SEQ ID NO: 597 - DNA, 66 bp, Artificial Sequence
  Primer
ccaggctttttgacaacaccatgctccgcgcccgggcgcggagcatggtgttgtcaaaaagcctgg

SEQ ID NO: 598 - DNA, 78 bp, Artificial Sequence
  Primer
caacgctatggagcgcgcccatcgtctgcaccagctggcgccagctggtgcagacgatgggcgcgctccatagcgttg

SEQ ID NO: 599 - DNA, 78 bp, Artificial Sequence
  Primer
caacgctatggaccgcgcccatcgtctgcaccagctggcgccagctggtgcagacgatgggcgcggtccatagcgttg

SEQ ID NO: 600 - DNA, 78 bp, Artificial Sequence
  Primer
caacgctatgaagcgcgcccatcgtctgcaccagctggcgccagctggtgcagacgatgggcgcgcttcatagcgttg

SEQ ID NO: 601 - DNA, 78 bp, Artificial Sequence
  Primer
caacgctatgaggcgcgcccatcgtctgcaccagctggcgccagctggtgcagacgatgggcgcgcctcatagcgttg

SEQ ID NO: 602 - DNA, 78 bp, Artificial Sequence
  Primer
caacgctatgaaccgcgcccatcgtctgcaccagctggcgccagctggtgcagacgatgggcgcggttcatagcgttg

SEQ ID NO: 603 - DNA, 78 bp, Artificial Sequence
  Primer
caacgctatgcagcgcgcccatcgtctgcaccagctggcgccagctggtgcagacgatgggcgcgctgcatagcgttg

SEQ ID NO: 604 - DNA, 78 bp, Artificial Sequence
  Primer
caacgctatgagccgcgcccatcgtctgcaccagctggcgccagctggtgcagacgatgggcgcggctcatagcgttg

SEQ ID NO: 605 - DNA, 78 bp, Artificial Sequence
  Primer
caacgctatgacccgcgcccatcgtctgcaccagctggcgccagctggtgcagacgatgggcgcgggtcatagcgttg

SEQ ID NO: 606 - DNA, 74 bp, Artificial Sequence
  Primer
cgctatgctccgcgagcatcgtctgcaccagctggccggccagctggtgcagacgatgctcgcggagcatagcg

SEQ ID NO: 607 - DNA, 74 bp, Artificial Sequence
  Primer
cgctatgctccgcgaccatcgtctgcaccagctggccggccagctggtgcagacgatggtcgcggagcatagcg

SEQ ID NO: 608 - DNA, 74 bp, Artificial Sequence
  Primer
cgctatgctccgcaagcatcgtctgcaccagctggccggccagctggtgcagacgatgcttgcggagcatagcg

SEQ ID NO: 609 - DNA, 74 bp, Artificial Sequence
  Primer
cgctatgctccgcaggcatcgtctgcaccagctggccggccagctggtgcagacgatgcctgcggagcatagcg

SEQ ID NO: 610 - DNA, 74 bp, Artificial Sequence
  Primer
cgctatgctccgcaaccatcgtctgcaccagctggccggccagctggtgcagacgatggttgcggagcatagcg

SEQ ID NO: 611 - DNA, 74 bp, Artificial Sequence
  Primer
cgctatgctccgccagcatcgtctgcaccagctggccggccagctggtgcagacgatgctggcggagcatagcg

SEQ ID NO: 612 - DNA, 74 bp, Artificial Sequence
  Primer
cgctatgctccgcagccatcgtctgcaccagctggccggccagctggtgcagacgatggctgcggagcatagcg

SEQ ID NO: 613 - DNA, 74 bp, Artificial Sequence
  Primer
cgctatgctccgcacccatcgtctgcaccagctggccggccagctggtgcagacgatgggtgcggagcatagcg

SEQ ID NO: 614 - DNA, 62 bp, Artificial Sequence
  Primer
gctccgcgcccatcgtgagcaccagctggccggccagctggtgctcacgatgggcgcggagc

SEQ ID NO: 615 - DNA, 62 bp, Artificial Sequence
  Primer
gctccgcgcccatcgtgaccaccagctggccggccagctggtggtcacgatgggcgcggagc

SEQ ID NO: 616 - DNA, 62 bp, Artificial Sequence
  Primer
gctccgcgcccatcgtaagcaccagctggccggccagctggtgcttacgatgggcgcggagc

SEQ ID NO: 617 - DNA, 62 bp, Artificial Sequence
  Primer
gctccgcgcccatcgtaggcaccagctggccggccagctggtgcctacgatgggcgcggagc

SEQ ID NO: 618 - DNA, 62 bp, Artificial Sequence
  Primer
gctccgcgcccatcgtaaccaccagctggccggccagctggtggttacgatgggcgcggagc

SEQ ID NO: 619 - DNA, 62 bp, Artificial Sequence
  Primer
gctccgcgcccatcgtcagcaccagctggccggccagctggtgctgacgatgggcgcggagc

SEQ ID NO: 620 - DNA, 62 bp, Artificial Sequence
  Primer
gctccgcgcccatcgtagccaccagctggccggccagctggtggctacgatgggcgcggagc

SEQ ID NO: 621 - DNA, 62 bp, Artificial Sequence
  Primer
gctccgcgcccatcgtacccaccagctggccggccagctggtgggtacgatgggcgcggagc

SEQ ID NO: 622 - DNA, 74 bp, Artificial Sequence
  Primer
ccgcgcccatcgtctgcaccaggaggcctttgacaccggtgtcaaaggcctcctggtgcagacgatgggcgcgg

SEQ ID NO: 623 - DNA, 74 bp, Artificial Sequence
  Primer
ccgcgcccatcgtctgcaccaggacgcctttgacaccggtgtcaaaggcgtcctggtgcagacgatgggcgcgg

SEQ ID NO: 624 - DNA, 80 bp, Artificial Sequence
  Primer
gctccgcgcccatcgtctgcaccagaaggcctttgacaccggtgtcaaaggccttctggtgcagacgatgggcgcggagc

SEQ ID NO: 625 - DNA, 74 bp, Artificial Sequence
  Primer
ccgcgcccatcgtctgcaccagagggcctttgacaccggtgtcaaaggccctctggtgcagacgatgggcgcgg

SEQ ID NO: 626 - DNA, 80 bp, Artificial Sequence
  Primer
gctccgcgcccatcgtctgcaccagaacgcctttgacaccggtgtcaaaggcgttctggtgcagacgatgggcgcggagc

SEQ ID NO: 627 - DNA, 74 bp, Artificial Sequence
  Primer
ccgcgcccatcgtctgcaccagcaggcctttgacaccggtgtcaaaggcctgctggtgcagacgatgggcgcgg

SEQ ID NO: 628 - DNA, 74 bp, Artificial Sequence
  Primer
ccgcgcccatcgtctgcaccagagcgcctttgacaccggtgtcaaaggcgctctggtgcagacgatgggcgcgg

SEQ ID NO: 629 - DNA, 74 bp, Artificial Sequence
  Primer
ccgcgcccatcgtctgcaccagaccgcctttgacaccggtgtcaaaggcggtctggtgcagacgatgggcgcgg

SEQ ID NO: 630 - DNA, 80 bp, Artificial Sequence
  Primer
cgcgcccatcgtctgcaccagctggagtttgacacctaccggtaggtgtcaaactccagctggtgcagacgatgggcgcg

SEQ ID NO: 631 - DNA, 80 bp, Artificial Sequence
  Primer
cgcgcccatcgtctgcaccagctggactttgacacctaccggtaggtgtcaaagtccagctggtgcagacgatgggcgcg

SEQ ID NO: 632 - DNA, 80 bp, Artificial Sequence
  Primer
cgcgcccatcgtctgcaccagctgaagtttgacacctaccggtaggtgtcaaacttcagctggtgcagacgatgggcgcg

SEQ ID NO: 633 - DNA, 80 bp, Artificial Sequence
  Primer
cgcgcccatcgtctgcaccagctgaggtttgacacctaccggtaggtgtcaaacctcagctggtgcagacgatgggcgcg

SEQ ID NO: 634 - DNA, 80 bp, Artificial Sequence
  Primer
cgcgcccatcgtctgcaccagctgaactttgacacctaccggtaggtgtcaaagttcagctggtgcagacgatgggcgcg

SEQ ID NO: 635 - DNA, 80 bp, Artificial Sequence
  Primer
cgcgcccatcgtctgcaccagctgcagtttgacacctaccggtaggtgtcaaactgcagctggtgcagacgatgggcgcg

SEQ ID NO: 636 - DNA, 80 bp, Artificial Sequence
  Primer
cgcgcccatcgtctgcaccagctgagctttgacacctaccggtaggtgtcaaagctcagctggtgcagacgatgggcgcg

SEQ ID NO: 637 - DNA, 80 bp, Artificial Sequence
  Primer
cgcgcccatcgtctgcaccagctgacctttgacacctaccggtaggtgtcaaaggtcagctggtgcagacgatgggcgcg

SEQ ID NO: 638 - DNA, 60 bp, Artificial Sequence
  Primer
gcctggtgtacggcgagtctgacagcaacgcgttgctgtcagactcgccgtacaccaggc

SEQ ID NO: 639 - DNA, 60 bp, Artificial Sequence
  Primer
gcctggtgtacggcgactctgacagcaacgcgttgctgtcagagtcgccgtacaccaggc

SEQ ID NO: 640 - DNA, 76 bp, Artificial Sequence
  Primer
cgccaacagcctggtgtacggcaagtctgacagcaacgcgttgctgtcagacttgccgtacaccaggctgttggcg

SEQ ID NO: 641 - DNA, 60 bp, Artificial Sequence
  Primer
gcctggtgtacggcaggtctgacagcaacgcgttgctgtcagacctgccgtacaccaggc

SEQ ID NO: 642 - DNA, 76 bp, Artificial Sequence
  Primer
cgccaacagcctggtgtacggcaactctgacagcaacgcgttgctgtcagagttgccgtacaccaggctgttggcg

SEQ ID NO: 643 - DNA, 60 bp, Artificial Sequence
  Primer
gcctggtgtacggccagtctgacagcaacgcgttgctgtcagactggccgtacaccaggc

SEQ ID NO: 644 - DNA, 60 bp, Artificial Sequence
  Primer
gcctggtgtacggcagctctgacagcaacgcgttgctgtcagagctgccgtacaccaggc

SEQ ID NO: 645 - DNA, 60 bp, Artificial Sequence
  Primer
gcctggtgtacggcacctctgacagcaacgcgttgctgtcagaggtgccgtacaccaggc

SEQ ID NO: 646 - DNA, 64 bp, Artificial Sequence
  Primer
cggcgcctctgacagcaacgagtatgacctccggaggtcatactcgttgctgtcagaggcgccg

SEQ ID NO: 647 - DNA, 64 bp, Artificial Sequence
  Primer
cggcgcctctgacagcaacgactatgacctccggaggtcatagtcgttgctgtcagaggcgccg

SEQ ID NO: 648 - DNA, 64 bp, Artificial Sequence
  Primer
cggcgcctctgacagcaacaagtatgacctccggaggtcatacttgttgctgtcagaggcgccg

SEQ ID NO: 649 - DNA, 64 bp, Artificial Sequence
  Primer
cggcgcctctgacagcaacaggtatgacctccggaggtcatacctgttgctgtcagaggcgccg

SEQ ID NO: 650 - DNA, 64 bp, Artificial Sequence
  Primer
cggcgcctctgacagcaacaactatgacctccggaggtcatagttgttgctgtcagaggcgccg

SEQ ID NO: 651 - DNA, 64 bp, Artificial Sequence
  Primer
cggcgcctctgacagcaaccagtatgacctccggaggtcatactggttgctgtcagaggcgccg

SEQ ID NO: 652 - DNA, 64 bp, Artificial Sequence
  Primer
cggcgcctctgacagcaacagctatgacctccggaggtcatagctgttgctgtcagaggcgccg

SEQ ID NO: 653 - DNA, 64 bp, Artificial Sequence
  Primer
cggcgcctctgacagcaacacctatgacctccggaggtcataggtgttgctgtcagaggcgccg

SEQ ID NO: 654 - DNA, 78 bp, Artificial Sequence
  Primer
gcgcctctgacagcaacgtctatgacgagctaaaggaccggtcctttagctcgtcatagacgttgctgtcagaggcgc

SEQ ID NO: 655 - DNA, 78 bp, Artificial Sequence
  Primer
gcgcctctgacagcaacgtctatgacgacctaaaggaccggtcctttaggtcgtcatagacgttgctgtcagaggcgc

SEQ ID NO: 656 - DNA, 78 bp, Artificial Sequence
  Primer
gcgcctctgacagcaacgtctatgacaagctaaaggaccggtcctttagcttgtcatagacgttgctgtcagaggcgc

SEQ ID NO: 657 - DNA, 78 bp, Artificial Sequence
  Primer
gcgcctctgacagcaacgtctatgacaggctaaaggaccggtcctttagcctgtcatagacgttgctgtcagaggcgc

SEQ ID NO: 658 - DNA, 78 bp, Artificial Sequence
  Primer
gcgcctctgacagcaacgtctatgacaacctaaaggaccggtcctttaggttgtcatagacgttgctgtcagaggcgc

SEQ ID NO: 659 - DNA, 78 bp, Artificial Sequence
  Primer
gcgcctctgacagcaacgtctatgaccagctaaaggaccggtcctttagctggtcatagacgttgctgtcagaggcgc

SEQ ID NO: 660 - DNA, 78 bp, Artificial Sequence
  Primer
gcgcctctgacagcaacgtctatgacagcctaaaggaccggtcctttaggctgtcatagacgttgctgtcagaggcgc

SEQ ID NO: 661 - DNA, 78 bp, Artificial Sequence
  Primer
gcgcctctgacagcaacgtctatgacaccctaaaggaccggtcctttagggtgtcatagacgttgctgtcagaggcgc

SEQ ID NO: 662 - DNA, 68 bp, Artificial Sequence
  Primer
cgtctatgacctcgagaaggacctagaggaaggcgccttcctctaggtccttctcgaggtcatagacg

SEQ ID NO: 663 - DNA, 68 bp, Artificial Sequence
  Primer
cgtctatgacctcgacaaggacctagaggaaggcgccttcctctaggtccttgtcgaggtcatagacg

SEQ ID NO: 664 - DNA, 68 bp, Artificial Sequence
  Primer
cgtctatgacctcaagaaggacctagaggaaggcgccttcctctaggtccttcttgaggtcatagacg

SEQ ID NO: 665 - DNA, 68 bp, Artificial Sequence
  Primer
cgtctatgacctcaggaaggacctagaggaaggcgccttcctctaggtccttcctgaggtcatagacg

SEQ ID NO: 666 - DNA, 68 bp, Artificial Sequence
  Primer
cgtctatgacctcaacaaggacctagaggaaggcgccttcctctaggtccttgttgaggtcatagacg

SEQ ID NO: 667 - DNA, 68 bp, Artificial Sequence
  Primer
cgtctatgacctccagaaggacctagaggaaggcgccttcctctaggtccttctggaggtcatagacg

SEQ ID NO: 668 - DNA, 68 bp, Artificial Sequence
  Primer
cgtctatgacctcagcaaggacctagaggaaggcgccttcctctaggtccttgctgaggtcatagacg

SEQ ID NO: 669 - DNA, 68 bp, Artificial Sequence
  Primer
cgtctatgacctcaccaaggacctagaggaaggcgccttcctctaggtccttggtgaggtcatagacg

SEQ ID NO: 670 - DNA, 62 bp, Artificial Sequence
  Primer
gacctcctaaaggacgaggaggaaggcatccggatgccttcctcctcgtcctttaggaggtc

SEQ ID NO: 671 - DNA, 62 bp, Artificial Sequence
  Primer
gacctcctaaaggacgacgaggaaggcatccggatgccttcctcgtcgtcctttaggaggtc

SEQ ID NO: 672 - DNA, 62 bp, Artificial Sequence
  Primer
gacctcctaaaggacaaggaggaaggcatccggatgccttcctccttgtcctttaggaggtc

SEQ ID NO: 673 - DNA, 62 bp, Artificial Sequence
  Primer
gacctcctaaaggacagggaggaaggcatccggatgccttcctccctgtcctttaggaggtc

SEQ ID NO: 674 - DNA, 62 bp, Artificial Sequence
  Primer
gacctcctaaaggacaacgaggaaggcatccggatgccttcctcgttgtcctttaggaggtc

SEQ ID NO: 675 - DNA, 62 bp, Artificial Sequence
  Primer
gacctcctaaaggaccaggaggaaggcatccggatgccttcctcctggtcctttaggaggtc

SEQ ID NO: 676 - DNA, 62 bp, Artificial Sequence
  Primer
gacctcctaaaggacagcgaggaaggcatccggatgccttcctcgctgtcctttaggaggtc

SEQ ID NO: 677 - DNA, 62 bp, Artificial Sequence
  Primer
gacctcctaaaggacaccgaggaaggcatccggatgccttcctcggtgtcctttaggaggtc

SEQ ID NO: 678 - DNA, 76 bp, Artificial Sequence
  Primer
cctagaggaaggcgagcaaacgctgatggggaggctggccagcctccccatcagcgtttgctcgccttcctctagg

SEQ ID NO: 679 - DNA, 76 bp, Artificial Sequence
  Primer
cctagaggaaggcgaccaaacgctgatggggaggctggccagcctccccatcagcgtttggtcgccttcctctagg

SEQ ID NO: 680 - DNA, 76 bp, Artificial Sequence
  Primer
cctagaggaaggcaagcaaacgctgatggggaggctggccagcctccccatcagcgtttgcttgccttcctctagg

SEQ ID NO: 681 - DNA, 76 bp, Artificial Sequence
  Primer
cctagaggaaggcaggcaaacgctgatggggaggctggccagcctccccatcagcgtttgcctgccttcctctagg

SEQ ID NO: 682 - DNA, 76 bp, Artificial Sequence
  Primer
cctagaggaaggcaaccaaacgctgatggggaggctggccagcctccccatcagcgtttggttgccttcctctagg

SEQ ID NO: 683 - DNA, 76 bp, Artificial Sequence
  Primer
cctagaggaaggccagcaaacgctgatggggaggctggccagcctccccatcagcgtttgctggccttcctctagg

SEQ ID NO: 684 - DNA, 76 bp, Artificial Sequence
  Primer
cctagaggaaggcagccaaacgctgatggggaggctggccagcctccccatcagcgtttggctgccttcctctagg

SEQ ID NO: 685 - DNA, 76 bp, Artificial Sequence
  Primer
cctagaggaaggcacccaaacgctgatggggaggctggccagcctccccatcagcgtttgggtgccttcctctagg

SEQ ID NO: 686 - DNA, 80 bp, Artificial Sequence
  Primer
gcatccaaacggagatggggaggctggaagatggcagcccgggctgccatcttccagcctccccatctccgtttggatgc

SEQ ID NO: 687 - DNA, 80 bp, Artificial Sequence
  Primer
gcatccaaacggacatggggaggctggaagatggcagcccgggctgccatcttccagcctccccatgtccgtttggatgc

SEQ ID NO: 688 - DNA, 80 bp, Artificial Sequence
  Primer
gcatccaaacgaagatggggaggctggaagatggcagcccgggctgccatcttccagcctccccatcttcgtttggatgc

SEQ ID NO: 689 - DNA, 79 bp, Artificial Sequence
  Primer
gcatccaaacgaggatggggaggctggaagatggcagcccggctgccatcttccagcctccccatcctcgtttggatgc

SEQ ID NO: 690 - DNA, 80 bp, Artificial Sequence
  Primer
gcatccaaacgaacatggggaggctggaagatggcagcccgggctgccatcttccagcctccccatgttcgtttggatgc

SEQ ID NO: 691 - DNA, 80 bp, Artificial Sequence
  Primer
gcatccaaacgcagatggggaggctggaagatggcagcccgggctgccatcttccagcctccccatctgcgtttggatgc

SEQ ID NO: 692 - DNA, 80 bp, Artificial Sequence
  Primer
gcatccaaacgagcatggggaggctggaagatggcagcccgggctgccatcttccagcctccccatgctcgtttggatgc

SEQ ID NO: 693 - DNA, 80 bp, Artificial Sequence
  Primer
gcatccaaacgaccatggggaggctggaagatggcagcccgggctgccatcttccagcctccccatggtcgtttggatgc

SEQ ID NO: 694 - DNA, 70 bp, Artificial Sequence
  Primer
cgctgatggggagggaggaagatggcagcccccggccgggggctgccatcttcctccctccccatcagcg

SEQ ID NO: 695 - DNA, 70 bp, Artificial Sequence
  Primer
cgctgatggggagggacgaagatggcagcccccggccgggggctgccatcttcgtccctccccatcagcg

SEQ ID NO: 696 - DNA, 70 bp, Artificial Sequence
  Primer
cgctgatggggaggaaggaagatggcagcccccggccgggggctgccatcttccttcctccccatcagcg

SEQ ID NO: 697 - DNA, 70 bp, Artificial Sequence
  Primer
cgctgatggggaggagggaagatggcagcccccggccgggggctgccatcttccctcctccccatcagcg

SEQ ID NO: 698 - DNA, 70 bp, Artificial Sequence
  Primer
cgctgatggggaggaacgaagatggcagcccccggccgggggctgccatcttcgttcctccccatcagcg

SEQ ID NO: 699 - DNA, 70 bp, Artificial Sequence
  Primer
cgctgatggggaggcaggaagatggcagcccccggccgggggctgccatcttcctgcctccccatcagcg

SEQ ID NO: 700 - DNA, 70 bp, Artificial Sequence
  Primer
cgctgatggggaggagcgaagatggcagcccccggccgggggctgccatcttcgctcctccccatcagcg

SEQ ID NO: 701 - DNA, 70 bp, Artificial Sequence
  Primer
cgctgatggggaggaccgaagatggcagcccccggccgggggctgccatcttcggtcctccccatcagcg

SEQ ID NO: 702 - DNA, 32 bp, Artificial Sequence
  Primer
atggctacaggctcccggacgtccctgcctcc

SEQ ID NO: 703 - DNA, 37 bp, Artificial Sequence
  Primer
ctagaagccacaagctgcccctccacagagcggcact

SEQ ID NO: 704 - DNA, 30 bp, Artificial Sequence
  Primer
aaaaagcttatggctacaggctcccggacg

SEQ ID NO: 705 - DNA, 32 bp, Artificial Sequence
  Primer
gcccttctagaagccacagctgccctccacag

SEQ ID NO: 706 - DNA, 38 bp, Artificial Sequence
  Primer
gggaattccatatgttcccgaccattccgttatccagg

SEQ ID NO: 707 - DNA, 39 bp, Artificial Sequence
  Primer
cgggatcccttaagaagccacagctgccctccacagagc

SEQ ID NO: 708 - DNA, 31 bp, Artificial Sequence
  Primer
ccgaccattccgttacccgtctttttgacaa

SEQ ID NO: 709 - DNA, 32 bp, Artificial Sequence
  Primer
gagcatagcgttgtcaaaaagacgggataacg

SEQ ID NO: 710 - DNA, 36 bp, Artificial Sequence
  Primer
gacaacgctatgctccgtgcccatcgtctgcaccag

SEQ ID NO: 711 - DNA, 36 bp, Artificial Sequence
  Primer
ctggtgcagacgatgggcacggagcatagcgttgtc

SEQ ID NO: 712 - protein, 217 aa, Homo sapiens
  ref <308>: DATABASE ACCESSION NUMBER: GenBank NP_002050.1
  ref <309>: DATABASE ENTRY DATE: 2004-10-26
MAAGSRTSLLLAFGLLCLSWLQEGSAFPTIPLSRLFDNAMLRARRLYQLAYDTYQEFEEAYILKEQKYSFLQNPQTSLCFSESIPTPSNRVKTQQKSNLELLRISLLLIQSWLEPVQLLRSVFANSLVYGASDSNVYRHLKDLEEGIQTLMWRLEDGSPRTGQIFNQSYSKFDTKSHNDDALLKNYGLLYCFRKDMDKVETFLRIVQCRSVEGSCGF

SEQ ID NO: 713 - protein, 217 aa, Homo sapiens
  ref <308>: DATABASE ACCESSION NUMBER: GenBank NP_000506.2
  ref <309>: DATABASE ENTRY DATE: 2004-10-26
MATGSRTSLLLAFGLLCLPWLQEGSAFPTIPLSRLFDNAMLRAHRLHQLAFDTYQEFEEAYIPKEQKYSFLQNPQTSLCFSESIPTPSNREETQQKSNLELLRISLLLIQSWLEPVQFLRSVFANSLVYGASDSNVYDLLKDLEEGIQTLMGRLEDGSPRTGQIFKQTYSKFDTNSHNDDALLKNYGLLYCFRKDMDKVETFLRIVQCRSVEGSCGF

SEQ ID NO: 714 - protein, 217 aa, Bos taurus
  ref <308>: DATABASE ACCESSION NUMBER: GenBank P01246
  ref <309>: DATABASE ENTRY DATE: 1986-07-21
MMAAGPRTSLLLAFALLCLPWTQVVGAFPAMSLSGLFANAVLRAQHLHQLAADTFKEFERTYIPEGQRYSIQNTQVAFCFSETIPAPTGKNEAQQKSDLELLRISLLLIQSWLGPLQFLSRVFTNSLVFGTSDRVYEKLKDLEEGILALMRELEDGTPRAGQILKQTYDKFDTNMRSDDALLKNYGLLSCFRKDLHKTETYLRVMKCRRFGEASCAF

SEQ ID NO: 715 - protein, 157 aa, Macaca mulatta
  ref <308>: DATABASE ACCESSION NUMBER: GenBank P33093
  ref <309>: DATABASE ENTRY DATE: 1993-10-01
MAAGSRTSLLLAFALLCLPWLQEGSAFPTIPLSRLFDNAMLRAHRLHQLAFDTYQEFEEAYIPKEQKYSFLQNPQTSLCFSESIPTPSNREETQQKSNLELLRISLLLIQSWLEPVQFLRALLKNYGLLYCFRKDMDKIETFLRIVQCRSVEGSCGF

SEQ ID NO: 716 - DNA, 3821 bp, Artificial Sequence
  pNAUT hGH vector
gcgcccaatacgcaaaccgcctctccccgcgcgttggccgattcattaatgcagctgctaggggttccttgtagttaatgattaacccgccatgctacttatctactatgccaagtacgccccctattgacgtcaatgacggtaaatggcccgcctggcattatgcccagtacatgaccttatgggactttcctacttggcagtacatctacgtattagtcatcgctattaccatggtgatgcggttttggcagtacatcaatgggcgtggatagcggtttgactcacggggatttccaagtctccaccccattgacgtcaatgggagtttgttttggcaccaaaatcaacgggactttccaaaatgtcgtaacaactccgccccattgacgcaaatgggcggtaggcgtgtacggtgggaggtctatataagcagagctctctggctaactagagaacccactgcttactggcttatcgaaattaatacgactcactatagggagacccaagcttatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagagggccctattctatagtgtcacctaaatgctagagctcgctgatcagcctcgactgtgccttctagttgccagccatctgttgtttgcccctcccccgtgccttccttgaccctggaaggtgccactcccactgtcctttcctaataaaatgaggaaattgcatcgcattgtctgagtaggtgtcattctattctggggggtggggtggggcaggacagcaagggggaggattgggaagacaatagcaggcatgctggggatgcggtgggctctatggcttctgaggcggaaagaaccaggtagataagtagcatggcgggttaatcattaactacacagctggcgtaatagcgaagaggcccgcaccgatcgcccttcccaacagttgcgcagcctgaatggcgaatggcgcctgatgcggtattttctccttacgcatctgtgcggtatttcacaccgcatatggtgcactctcagtacaatctgctctgatgccgcatagttaagccagccccgacacccgccaacacccgctgacgcgccctgacgggcttgtctgctcccggcatccgcttacagacaagctgtgaccgtctccgggagctgcatgtgtcagaggttttcaccgtcatcaccgaaacgcgcgagacgaaagggcctcgtgatacgcctatttttataggttaatgtcatgataataatggtttcttagacgtcaggtggcacttttcggggaaatgtgcgcggaacccctatttgtttatttttctaaatacattcaaatatgtatccgctcatgagacaataaccctgataaatgcttcaataatattgaaaaaggaagagtatgagtattcaacatttccgtgtcgcccttattcccttttttgcggcattttgccttcctgtttttgctcacccagaaacgctggtgaaagtaaaagatgctgaagatcagttgggtgcacgagtgggttacatcgaactggatctcaacagcggtaagatccttgagagttttcgccccgaagaacgttttccaatgatgagcacttttaaagttctgctatgtggcgcggtattatcccgtattgacgccgggcaagagcaactcggtcgccgcatacactattctcagaatgacttggttgagtactcaccagtcacagaaaagcatcttacggatggcatgacagtaagagaattatgcagtgctgccataaccatgagtgataacactgcggccaacttacttctgacaacgatcggaggaccgaaggagctaaccgcttttttgcacaacatgggggatcatgtaactcgccttgatcgttgggaaccggagctgaatgaagccataccaaacgacgagcgtgacaccacgatgcctgtagcaatggcaacaacgttgcgcaaactattaactggcgaactacttactctagcttcccggcaacaattaatagactggatggaggcggataaagttgcaggaccacttctgcgctcggcccttccggctggctggtttattgctgataaatctggagccggtgagcgtgggtctcgcggtatcattgcagcactggggccagatggtaagccctcccgtatcgtagttatctacacgacggggagtcaggcaactatggatgaacgaaatagacagatcgctgagataggtgcctcactgattaagcattggtaactgtcagaccaagtttactcatatatactttagattgatttaaaacttcatttttaatttaaaaggatctaggtgaagatcctttttgataatctcatgaccaaaatcccttaacgtgagttttcgttccactgagcgtcagaccccgtagaaaagatcaaaggatcttcttgagatcctttttttctgcgcgtaatctgctgcttgcaaacaaaaaaaccaccgctaccagcggtggtttgtttgccggatcaagagctaccaactctttttccgaaggtaactggcttcagcagagcgcagataccaaatactgtccttctagtgtagccgtagttaggccaccacttcaagaactctgtagcaccgcctacatacctcgctctgctaatcctgttaccagtggctgctgccagtggcgataagtcgtgtcttaccgggttggactcaagacgatagttaccggataaggcgcagcggtcgggctgaacggggggttcgtgcacacagcccagcttggagcgaacgacctacaccgaactgagatacctacagcgtgagctatgagaaagcgccacgcttcccgaagggagaaaggcggacaggtatccggtaagcggcagggtcggaacaggagagcgcacgagggagcttccagggggaaacgcctggtatctttatagtcctgtcgggtttcgccacctctgacttgagcgtcgatttttgtgatgctcgtcaggggggcggagcctatggaaaaacgccagcaacgcggcctttttacggttcctggccttttgctggccttttgctcacatgttctttcctgcgttatcccctgattctgtggataaccgtattaccgcctttgagtgagctgataccgctcgccgcagccgaacgaccgagcgcagcgagtcagtgagcgaggaagcggaaga

SEQ ID NO: 717 - DNA, 4611 bp, Artificial Sequence
  pTOPO hGH vector
cttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaagcccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgagattatcaaaaaggatcttcacctagatccttttaaattaaaaatgaagttttaaatcaatctaaagtatatatgagtaaacttggtctgacagttaccaatgcttaatcagtgaggcacctatctcagcgatctgtctatttcgttcatccatagttgcctgactccccgtcgtgtagataactacgatacgggagggcttaccatctggccccagtgctgcaatgataccgcgagacccacgctcaccggctccagatttatcagcaataaaccagccagccggaagggccgagcgcagaagtggtcctgcaactttatccgcctccatccagtctattaattgttgccgggaagctagagtaagtagttcgccagttaatagtttgcgcaacgttgttgccattgctacaggcatcgtggtgtcacgctcgtcgtttggtatggcttcattcagctccggttcccaacgatcaaggcgagttacatgatcccccatgttgtgcaaaaaagcggttagctccttcggtcctccgatcgttgtcagaagtaagttggccgcagtgttatcactcatggttatggcagcactgcataattctcttactgtcatgccatccgtaagatgcttttctgtgactggtgagtactcaaccaagtcattctgagaatagtgtatgcggcgaccgagttgctcttgcccggcgtcaatacgggataataccgcgccacatagcagaactttaaaagtgctcatcattggaaaacgttcttcggggcgaaaactctcaaggatcttaccgctgttgagatccagttcgatgtaacccactcgtgcacccaactgatcttcagcatcttttactttcaccagcgtttctgggtgagcaaaaacaggaaggcaaaatgccgcaaaaaagggaataagggcgacacggaaatgttgaatactcatactcttcctttttcaatattattgaagcatttatcagggttattgtctcatgagcggatacatatttgaatgtatttagaaaaataaacaaataggggttccgcgcacatttccccgaaaagtgccacctgtatgcggtgtgaaataccgcacagatgcgtaaggagaaaataccgcatcaggaaattgtaagcgttaataattcagaagaactcgtcaagaaggcgatagaaggcgatgcgctgcgaatcgggagcggcgataccgtaaagcacgaggaagcggtcagcccattcgccgccaagctcttcagcaatatcacgggtagccaacgctatgtcctgatagcggtccgccacacccagccggccacagtcgatgaatccagaaaagcggccattttccaccatgatattcggcaagcaggcatcgccatgggtcacgacgagatcctcgccgtcgggcatgctcgccttgagcctggcgaacagttcggctggcgcgagcccctgatgctcttcgtccagatcatcctgatcgacaagaccggcttccatccgagtacgtgctcgctcgatgcgatgtttcgcttggtggtcgaatgggcaggtagccggatcaagcgtatgcagccgccgcattgcatcagccatgatggatactttctcggcaggagcaaggtgagatgacaggagatcctgccccggcacttcgcccaatagcagccagtcccttcccgcttcagtgacaacgtcgagcacagctgcgcaaggaacgcccgtcgtggccagccacgatagccgcgctgcctcgtcttgcagttcattcagggcaccggacaggtcggtcttgacaaaaagaaccgggcgcccctgcgctgacagccggaacacggcggcatcagagcagccgattgtctgttgtgcccagtcatagccgaatagcctctccacccaagcggccggagaacctgcgtgcaatccatcttgttcaatcatgcgaaacgatcctcatcctgtctcttgatcagagcttgatcccctgcgccatcagatccttggcggcgagaaagccatccagtttactttgcagggcttcccaaccttaccagagggcgccccagctggcaattccggttcgcttgctgtccataaaaccgcccagtctagctatcgccatgtaagcccactgcaagctacctgctttctctttgcgcttgcgttttcccttgtccagatagcccagtagctgacattcatccggggtcagcaccgtttctgcggactggctttctacgtgaaaaggatctaggtgaagatcctttttgataatctcatgcctgacatttatattccccagaacatcaggttaatggcgtttttgatgtcattttcgcggtggctgagatcagccacttcttccccgataacggagaccggcacactggccatatcggtggtcatcatgcgccagctttcatccccgatatgcaccaccgggtaaagttcacgggagactttatctgacagcagacgtgcactggccagggggatcaccatccgtcgccccggcgtgtcaataatatcactctgtacatccacaaacagacgataacggctctctcttttataggtgtaaaccttaaactgccgtacgtataggctgcgcaactgttgggaagggcgatcggtgcgggcctcttcgctattacgccagctggcgaaagggggatgtgctgcaaggcgattaagttgggtaacgccagggttttcccagtcacgacgttgtaaaacgacggccagtgaattgtaatacgactcactatagggcgaattgaatttagcggccgcgaattcgcccttatggctacaggctcccggacgtccctgctcctggcttttggcctgctctgcctgccctggcttcaagagggcagtgccttcccaaccattcccttatccaggctttttgacaacgctatgctccgcgcccatcgtctgcaccagctggcctttgacacctaccaggagtttgaagaagcctatatcccaaaggaacagaagtattcattcctgcagaacccccagacctccctctgtttctcagagtctattccgacaccctccaacagggaggaaacacaacagaaatccaacctagagctgctccgcatctccctgctgctcatccagtcgtggctggagcccgtgcagttcctcaggagtgtcttcgccaacagcctggtgtacggcgcctctgacagcaacgtctatgacctcctaaaggacctagaggaaggcatccaaacgctgatggggaggctggaagatggcagcccccggactgggcagatcttcaagcagacctacagcaagttcgacacaaactcacacaacgatgacgcactactcaagaactacgggctgctctactgcttcaggaaggacatggacaaggtcgagacattcctgcgcatcgtgcagtgccgctctgtggagggcagctgtggcttctagaagggcgaattcgtttaaacctgcaggactagtccctttagtgagggttaattctgagcttggcgtaatcatggtcatagctgtttcctgtgtgaaattgttatccgctcacaattccacacaacatacgagccggaagcataaagtgtaaagcctggggtgcctaatgagtgagctaactcacattaattgcgttgcgctcactgcccgctttccagtcgggaaacctgtcgtgccagctgcattaatgaatcggccaacgcgcggggagaggcggtttgcgtattgggcgct

SEQ ID NO: 718 - DNA, 5236 bp, Artificial Sequence
  pET - 24 vector
atccggatatagttcctcctttcagcaaaaaacccctcaagacccgtttagaggccccaaggggttatgctagttattgctcagcggtggcagcagccaactcagcttcctttcgggctttgttagcagccggatctcagtggtggtggtggtggtgctcgagtgcggccgcaagcttgtcgacggagctcgaattcggatcctagaggggaattgttatccgctcacaattcccctatagtgagtcgtattaatttcgcgggatcgagatctcgatcctctacgccggacgcatcgtggccggcatcaccggcgccacaggtgcggttgctggcgcctatatcgccgacatcaccgatggggaagatcgggctcgccacttcgggctcatgagcgcttgtttcggcgtgggtatggtggcaggccccgtggccgggggactgttgggcgccatctccttgcatgcaccattccttgcggcggcggtgctcaacggcctcaacctactactgggctgcttcctaatgcaggagtcgcataagggagagcgtcgagatcccggacaccatcgaatggcgcaaaacctttcgcggtatggcatgatagcgcccggaagagagtcaattcagggtggtgaatgtgaaaccagtaacgttatacgatgtcgcagagtatgccggtgtctcttatcagaccgtttcccgcgtggtgaaccaggccagccacgtttctgcgaaaacgcgggaaaaagtggaagcggcgatggcggagctgaattacattcccaaccgcgtggcacaacaactggcgggcaaacagtcgttgctgattggcgttgccacctccagtctggccctgcacgcgccgtcgcaaattgtcgcggcgattaaatctcgcgccgatcaactgggtgccagcgtggtggtgtcgatggtagaacgaagcggcgtcgaagcctgtaaagcggcggtgcacaatcttctcgcgcaacgcgtcagtgggctgatcattaactatccgctggatgaccaggatgccattgctgtggaagctgcctgcactaatgttccggcgttatttcttgatgtctctgaccagacacccatcaacagtattattttctcccatgaagacggtacgcgactgggcgtggagcatctggtcgcattgggtcaccagcaaatcgcgctgttagcgggcccattaagttctgtctcggcgcgtctgcgtctggctggctggcataaatatctcactcgcaatcaaattcagccgatagcggaacgggaaggcgactggagtgccatgtccggttttcaacaaaccatgcaaatgctgaatgagggcatcgttcccactgcgatgctggttgccaacgatcagatggcgctgggcgcaatgcgcgccattaccgagtccgggctgcgcgttggtgcggatatctcggtagtgggatacgacgataccgaagacagctcatgttatatcccgccgttaaccaccatcaaacaggattttcgcctgctggggcaaaccagcgtggaccgcttgctgcaactctctcagggccaggcggtgaagggcaatcagctgttgcccgtctcactggtgaaaagaaaaaccaccctggcgcccaatacgcaaaccgcctctccccgcgcgttggccgattcattaatgcagctggcacgacaggtttcccgactggaaagcgggcagtgagcgcaacgcaattaatgtaagttagctcactcattaggcaccgggatctcgaccgatgcccttgagagccttcaacccagtcagctccttccggtgggcgcggggcatgactatcgtcgccgcacttatgactgtcttctttatcatgcaactcgtaggacaggtgccggcagcgctctgggtcattttcggcgaggaccgctttcgctggagcgcgacgatgatcggcctgtcgcttgcggtattcggaatcttgcacgccctcgctcaagccttcgtcactggtcccgccaccaaacgtttcggcgagaagcaggccattatcgccggcatggcggccccacgggtgcgcatgatcgtgctcctgtcgttgaggacccggctaggctggcggggttgccttactggttagcagaatgaatcaccgatacgcgagcgaacgtgaagcgactgctgctgcaaaacgtctgcgacctgagcaacaacatgaatggtcttcggtttccgtgtttcgtaaagtctggaaacgcggaagtcagcgccctgcaccattatgttccggatctgcatcgcaggatgctgctggctaccctgtggaacacctacatctgtattaacgaagcgctggcattgaccctgagtgatttttctctggtcccgccgcatccataccgccagttgtttaccctcacaacgttccagtaaccgggcatgttcatcatcagtaacccgtatcgtgagcatcctctctcgtttcatcggtatcattacccccatgaacagaaatcccccttacacggaggcatcagtgaccaaacaggaaaaaaccgcccttaacatggcccgctttatcagaagccagacattaacgcttctggagaaactcaacgagctggacgcggatgaacaggcagacatctgtgaatcgcttcacgaccacgctgatgagctttaccgcagctgcctcgcgcgtttcggtgatgacggtgaaaacctctgacacatgcagctcccggagacggtcacagcttgtctgtaagcggatgccgggagcagacaagcccgtcagggcgcgtcagcgggtgttggcgggtgtcggggcgcagccatgacccagtcacgtagcgatagcggagtgtatactggcttaactatgcggcatcagagcagattgtactgagagtgcaccatatatgcggtgtgaaataccgcacagatgcgtaaggagaaaataccgcatcaggcgctcttccgcttcctcgctcactgactcgctgcgctcggtcgttcggctgcggcgagcggtatcagctcactcaaaggcggtaatacggttatccacagaatcaggggataacgcaggaaagaacatgtgagcaaaaggccagcaaaaggccaggaaccgtaaaaaggccgcgttgctggcgtttttccataggctccgcccccctgacgagcatcacaaaaatcgacgctcaagtcagaggtggcgaaacccgacaggactataaagataccaggcgtttccccctggaagctccctcgtgcgctctcctgttccgaccctgccgcttaccggatacctgtccgcctttctcccttcgggaagcgtggcgctttctcatagctcacgctgtaggtatctcagttcggtgtaggtcgttcgctccaagctgggctgtgtgcacgaaccccccgttcagcccgaccgctgcgccttatccggtaactatcgtcttgagtccaacccggtaagacacgacttatcgccactggcagcagccactggtaacaggattagcagagcgaggtatgtaggcggtgctacagagttcttgaagtggtggcctaactacggctacactagaaggacagtatttggtatctgcgctctgctgaagccagttaccttcggaaaaagagttggtagctcttgatccggcaaacaaaccaccgctggtagcggtggtttttttgtttgcaagcagcagattacgcgcagaaaaaaaggatctcaagaagatcctttgatcttttctacggggtctgacgctcagtggaacgaaaactcacgttaagggattttggtcatgaacaataaaactgtctgcttacataaacagtaatacaaggggtgttatgagccatattcaacgggaaacgtcttgctctaggccgcgattaaattccaacatggatgctgatttatatgggtataaatgggctcgcgataatgtcgggcaatcaggtgcgacaatctatcgattgtatgggaagcccgatgcgccagagttgtttctgaaacatggcaaaggtagcgttgccaatgatgttacagatgagatggtcagactaaactggctgacggaatttatgcctcttccgaccatcaagcattttatccgtactcctgatgatgcatggttactcaccactgcgatccccgggaaaacagcattccaggtattagaagaatatcctgattcaggtgaaaatattgttgatgcgctggcagtgttcctgcgccggttgcattcgattcctgtttgtaattgtccttttaacagcgatcgcgtatttcgtctcgctcaggcgcaatcacgaatgaataacggtttggttgatgcgagtgattttgatgacgagcgtaatggctggcctgttgaacaagtctggaaagaaatgcataaacttttgccattctcaccggattcagtcgtcactcatggtgatttctcacttgataaccttatttttgacgaggggaaattaataggttgtattgatgttggacgagtcggaatcgcagaccgataccaggatcttgccatcctatggaactgcctcggtgagttttctccttcattacagaaacggctttttcaaaaatatggtattgataatcctgatatgaataaattgcagtttcatttgatgctcgatgagtttttctaagaattaattcatgagcggatacatatttgaatgtatttagaaaaataaacaaataggggttccgcgcacatttccccgaaaagtgccacctgaaattgtaaacgttaatattttgttaaaattcgcgttaaatttttgttaaatcagctcattttttaaccaataggccgaaatcggcaaaatcccttataaatcaaaagaatagaccgagatagggttgagtgttgttccagtttggaacaagagtccactattaaagaacgtggactccaacgtcaaagggcgaaaaaccgtctatcagggcgatggcccactacgtgaaccatcaccctaatcaagttttttggggtcgaggtgccgtaaagcactaaatcggaaccctaaagggagcccccgatttagagcttgacggggaaagccggcgaacgtggcgagaaaggaagggaagaaagcgaaaggagcgggcgctagggcgctggcaagtgtagcggtcacgctgcgcgtaaccaccacacccgccgcgcttaatgcgccgctacagggcgcgtcccattcgcca

SEQ ID NO: 719 - DNA, 10574 bp, Artificial Sequence
  pET24Naut-hGH Plasmid
ctagtcggggaaatgtgcgcggaacccctatttgtttatttttctaaatagatcagcccctttacacgcgccttggggataaacaaataaaaagatttatcattcaaatatgtatccgctcatgaattaattcttagaaaaactcatcgagtaagtttatacataggcgagtacttaattaagaatctttttgagtagctgcatcaaatgaaactgcaatttattcatatcaggattatcaataccatatcgtagtttactttgacgttaaataagtatagtcctaatagttatggtatattttgaaaaagccgtttctgtaatgaaggagaaaactcaccgaggcagttaaaactttttcggcaaagacattacttcctcttttgagtggctccgtcaaccataggatggcaagatcctggtatcggtctgcgattccgactcgtccaaggtatcctaccgttctaggaccatagccagacgctaaggctgagcaggttcatcaatacaacctattaatttcccctcgtcaaaaataaggttatcaagtgtagttatgttggataattaaaggggagcagtttttattccaatagttcagagaaatcaccatgagtgacgactgaatccggtgagaatggcaaaagtttctctttagtggtactcactgctgacttaggccactcttaccgttttcaaaatgcatttctttccagacttgttcaacaggccagccattacgctcgtcattacgtaaagaaaggtctgaacaagttgtccggtcggtaatgcgagcagtacaaaatcactcgcatcaaccaaaccgttattcattcgtgattgcgcctgagttttagtgagcgtagttggtttggcaataagtaagcactaacgcggactgcgagacgaaatacgcgatcgctgttaaaaggacaattacaaacaggaatcgctctgctttatgcgctagcgacaattttcctgttaatgtttgtccttacgaatgcaaccggcgcaggaacactgccagcgcatcaacaatattttcacgcttacgttggccgcgtccttgtgacggtcgcgtagttgttataaaagtgctgaatcaggatattcttctaatacctggaatgctgttttcccggggatcgacttagtcctataagaagattatggaccttacgacaaaagggcccctaggcagtggtgagtaaccatgcatcatcaggagtacggataaaatgcttgatcgtcaccactcattggtacgtagtagtcctcatgcctattttacgaactaggtcggaagaggcataaattccgtcagccagtttagtctgaccatctcatccagccttctccgtatttaaggcagtcggtcaaatcagactggtagagtactgtaacatcattggcaacgctacctttgccatgtttcagaaacaactctgacattgtagtaaccgttgcgatggaaacggtacaaagtctttgttgagaggcgcatcgggcttcccatacaatcgatagattgtcgcacctgattgcccccgcgtagcccgaagggtatgttagctatctaacagcgtggactaacggggacattatcgcgagcccatttatacccatataaatcagcatccatgttggctgtaatagcgctcgggtaaatatgggtatatttagtcgtaggtacaaccaatttaatcgcggcctagagcaagacgtttcccgttgaatatggctcatattaaattagcgccggatctcgttctgcaaagggcaacttataccgagtatacaccccttgtattactgtttatgtaagcagacagttttattgttcatgatgtggggaacataatgacaaatacattcgtctgtcaaaataacaagtactccaaaatcccttaacgtgagttttcgttccactgagcgtcagaccccgtaggttttagggaattgcactcaaaagcaaggtgactcgcagtctggggcatgaaaagatcaaaggatcttcttgagatcctttttttctgcgcgtaatctgcttttctagtttcctagaagaactctaggaaaaaaagacgcgcattagacctgcttgcaaacaaaaaaaccaccgctaccagcggtggtttgtttgccgggacgaacgtttgtttttttggtggcgatggtcgccaccaaacaaacggccatcaagagctaccaactctttttccgaaggtaactggcttcagcagagcgtagttctcgatggttgagaaaaaggcttccattgaccgaagtcgtctcgccagataccaaatactgtccttctagtgtagccgtagttaggccaccacttgtctatggtttatgacaggaagatcacatcggcatcaatccggtggtgaacaagaactctgtagcaccgcctacatacctcgctctgctaatcctgttacgttcttgagacatcgtggcggatgtatggagcgagacgattaggacaatgcagtggctgctgccagtggcgataagtcgtgtcttaccgggttggactcagtcaccgacgacggtcaccgctattcagcacagaatggcccaacctgagtagacgatagttaccggataaggcgcagcggtcgggctgaacggggggttctctgctatcaatggcctattccgcgtcgccagcccgacttgccccccaaggtgcacacagcccagcttggagcgaacgacctacaccgaactgagatacccacgtgtgtcgggtcgaacctcgcttgctggatgtggcttgactctatggtacagcgtgagctatgagaaagcgccacgcttcccgaagggagaaaggcgatgtcgcactcgatactctttcgcggtgcgaagggcttccctctttccgcgacaggtatccggtaagcggcagggtcggaacaggagagcgcacgagggactgtccataggccattcgccgtcccagccttgtcctctcgcgtgctccctgcttccagggggaaacgcctggtatctttatagtcctgtcgggtttcgcccgaaggtccccctttgcggaccatagaaatatcaggacagcccaaagcggacctctgacttgagcgtcgatttttgtgatgctcgtcaggggggcggagctggagactgaactcgcagctaaaaacactacgagcagtccccccgcctcgctatggaaaaacgccagcaacgcggcctttttacggttcctggccttttggatacctttttgcggtcgttgcgccggaaaaatgccaaggaccggaaaacctggccttttgctcacatgttctttcctgcgttatcccctgattctgtgggaccggaaaacgagtgtacaagaaaggacgcaataggggactaagacaccataaccgtattaccgcctttgagtgagctgataccgctcgccgcagccgatattggcataatggcggaaactcactcgactatggcgagcggcgtcggctacgaccgagcgcagcgagtcagtgagcgaggaagcggaagagcgcctgattgctggctcgcgtcgctcagtcactcgctccttcgccttctcgcggactagcggtattttctccttacgcatctgtgcggtatttcacaccgcaatggtgcgccataaaagaggaatgcgtagacacgccataaagtgtggcgttaccaccactctcagtacaatctgctctgatgccgcatagttaagccagtatacacgtgagagtcatgttagacgagactacggcgtatcaattcggtcatatgtgtccgctatcgctacgtgactgggtcatggctgcgccccgacacccgccaaaggcgatagcgatgcactgacccagtaccgacgcggggctgtgggcggttcacccgctgacgcgccctgacgggcttgtctgctcccggcatccgcttacgtgggcgactgcgcgggactgcccgaacagacgagggccgtaggcgaatgagacaagctgtgaccgtctccgggagctgcatgtgtcagaggttttcacctctgttcgacactggcagaggccctcgacgtacacagtctccaaaagtgggtcatcaccgaaacgcgcgaggcagctgcggtaaagctcatcagcgtggtcagtagtggctttgcgcgctccgtcgacgccatttcgagtagtcgcaccacgtgaagcgattcacagatgtctgcctgttcatccgcgtccagctcgttggcacttcgctaagtgtctacagacggacaagtaggcgcaggtcgagcaacagtttctccagaagcgttaatgtctggcttctgataaagcgggccatgtttcaaagaggtcttcgcaattacagaccgaagactatttcgcccggtacaaaagggcggttttttcctgtttggtcactgatgcctccgtgtaagggggatttcccgccaaaaaaggacaaaccagtgactacggaggcacattccccctattctgttcatgggggtaatgataccgatgaaacgagagaggatgctcacgaagacaagtacccccattactatggctactttgctctctcctacgagtgcatacgggttactgatgatgaacatgcccggttactggaacgttgtgagggtatgcccaatgactactacttgtacgggccaatgaccttgcaacactccctaaacaactggcggtatggatgcggcgggaccagagaaaaatcactcaggatttgttgaccgccatacctacgccgccctggtctctttttagtgagtccgtcaatgccagcgcttcgttaatacagatgtaggtgttccacagggtagccagttacggtcgcgaagcaattatgtctacatccacaaggtgtcccatcgcagcagcatcctgcgatgcagatccggaacataatggtgcagggcgctgagtcgtcgtaggacgctacgtctaggccttgtattaccacgtcccgcgactcttccgcgtttccagactttacgaaacacggaaaccgaagaccattcatggaaggcgcaaaggtctgaaatgctttgtgcctttggcttctggtaagtacttgttgctcaggtcgcagacgttttgcagcagcagtcgcttcacgttcgcaacaacgagtccagcgtctgcaaaacgtcgtcgtcagcgaagtgcaagcgtcgcgtatcggtgattcattctgctaaccagtaaggcaaccccgccagccagcgcatagccactaagtaagacgattggtcattccgttggggcggtcggtagccgggtcctcaacgacaggagcacgatcatgcgcacccgtggggccgatcggcccaggagttgctgtcctcgtgctagtacgcgtgggcaccccggcccatgccggcgataatggcctgcttctcgccgaaacgtttggtggcgggaggtacggccgctattaccggacgaagagcggctttgcaaaccaccgccctccagtgacgaaggcttgagcgagggcgtgcaagattccgaataccgcaagggtcactgcttccgaactcgctcccgcacgttctaaggcttatggcgttccgacaggccgatcatcgtcgcgctccagcgaaagcggtcctcgccgaaaagctgtccggctagtagcagcgcgaggtcgctttcgccaggagcggctttttgacccagagcgctgccggcacctgtcctacgagttgcatgataaagaagactgggtctcgcgacggccgtggacaggatgctcaacgtactatttcttcacagtcataagtgcggcgacgatagtcatgccccgcgcccaccggaaggatgtcagtattcacgccgctgctatcagtacggggcgcgggtggccttcctgctgactgggttgaaggctctcaagggcatcggtcgagatcccggtgcctcgactgacccaacttccgagagttcccgtagccagctctagggccacggaaatgagtgagctaacttacattaattgcgttgcgctcactgcccgctttcttactcactcgattgaatgtaattaacgcaacgcgagtgacgggcgaaagcagtcgggaaacctgtcgtgccagctgcattaatgaatcggccaacgcgcgtcagccctttggacagcacggtcgacgtaattacttagccggttgcgcgggggagaggcggtttgcgtattgggcgccagggtggtttttcttttcacccccctctccgccaaacgcataacccgcggtcccaccaaaaagaaaagtggagtgagacgggcaacagctgattgcccttcaccgcctggccctgagagagtcactctgcccgttgtcgactaacgggaagtggcggaccgggactctctcttgcagcaagcggtccacgctggtttgccccagcaggcgaaaatcctgttaacgtcgttcgccaggtgcgaccaaacggggtcgtccgcttttaggacaatgatggtggttaacggcgggatataacatgagctgtcttcggtatcgtcgactaccaccaattgccgccctatattgtactcgacagaagccatagcagctatcccactaccgagatatccgcaccaacgcgcagcccggactcggtaatatagggtgatggctctataggcgtggttgcgcgtcgggcctgagccattaggcgcgcattgcgcccagcgccatctgatcgttggcaaccagcatcgcagccgcgcgtaacgcgggtcgcggtagactagcaaccgttggtcgtagcgtctgggaacgatgccctcattcagcatttgcatggtttgttgaaaaccggacacccttgctacgggagtaagtcgtaaacgtaccaaacaacttttggcctgatggcactccagtcgccttcccgttccgctatcggctgaatttgattgcgtaccgtgaggtcagcggaagggcaaggcgatagccgacttaaactaacgcagtgagatatttatgccagccagccagacgcagacgcgccgagacagaactcactctataaatacggtcggtcggtctgcgtctgcgcggctctgtcttgttaatgggcccgctaacagcgcgatttgctggtgacccaatgcgaccagaaattacccgggcgattgtcgcgctaaacgaccactgggttacgctggtcttgctccacgcccagtcgcgtaccgtcttcatgggagaaaataatactgttacgaggtgcgggtcagcgcatggcagaagtaccctcttttattatgacaagatgggtgtctggtcagagacatcaagaaataacgccggaacattagtgcctacccacagaccagtctctgtagttctttattgcggccttgtaatcacgaggcagcttccacagcaatggcatcctggtcatccagcggatagttaatgtccgtcgaaggtgtcgttaccgtaggaccagtaggtcgcctatcaattacatcagcccactgacgcgttgcgcgagaagattgtgcaccgccgctttacatagtcgggtgactgcgcaacgcgctcttctaacacgtggcggcgaaatgtggcttcgacgccgcttcgttctaccatcgacaccaccacgctggcacccaccgaagctgcggcgaagcaagatggtagctgtggtggtgcgaccgtgggtgttgatcggcgcgagatttaatcgccgcgacaatttgcgacggcgcgtgccaactagccgcgctctaaattagcggcgctgttaaacgctgccgcgcacgagggccagactggaggtggcaacgccaatcagcaacgactgtttgcccgctcccggtctgacctccaccgttgcggttagtcgttgctgacaaacgggcgcagttgttgtgccacgcggttgggaatgtaattcagctccgccatcgccggtcaacaacacggtgcgccaacccttacattaagtcgaggcggtagcggccttccactttttcccgcgttttcgcagaaacgtggctggcctggttcaccgaaggtgaaaaagggcgcaaaagcgtctttgcaccgaccggaccaagtggacgcgggaaacggtctgataagagacaccggcatactctgcgacatcgtatgcgccctttgccagactattctctgtggccgtatgagacgctgtagcattaacgttactggtttcacattcaccaccctgaattgactctcttccgggcattgcaatgaccaaagtgtaagtggtgggacttaactgagagaaggcccggctatcatgccataccgcgaaaggttttgcgccattcgatggtgtccgggcgatagtacggtatggcgctttccaaaacgcggtaagctaccacaggcccatctcgacgctctcccttatgcgactcctgcattaggaagcagcccagtatagagctgcgagagggaatacgctgaggacgtaatccttcgtcgggtcatgtaggttgaggccgttgagcaccgccgccgcaaggaatggtgcatgcaagcatccaactccggcaactcgtggcggcggcgttccttaccacgtacgttcgagatggcgcccaacagtcccccggccacggggcctgccaccatacccacctctaccgcgggttgtcagggggccggtgccccggacggtggtatgggtggccgaaacaagcgctcatgagcccgaagtggcgagcccgatcttccccatcggctttgttcgcgagtactcgggcttcaccgctcgggctagaaggggtacggtgatgtcggcgatataggcgccagcaaccgcacctgtggcgccggtggccactacagccgctatatccgcggtcgttggcgtggacaccgcggccacatgccggccacgatgcgtccggcgtagaggatcgagatctcgatcccgcgtacggccggtgctacgcaggccgcatctcctagctctagagctagggcgcaaattaatacgactcactataggggaattgtgagcggataacaattcccctttaattatgctgagtgatatccccttaacactcgcctattgttaaggggtctagaaataattttgtttaactttaagaaggagatatacatatgttcccagatctttattaaaacaaattgaaattcttcctctatatgtatacaaggggaccattccgttatcccgtctttttgacaacgctatgctccgtgcccatcctggtaaggcaatagggcagaaaaactgttgcgatacgaggcacgggtaggtctgcaccagctggcctttgacacctaccaggagtttgaagaagcctatcagacgtggtcgaccggaaactgtggatggtcctcaaacttcttcggataatcccaaaggaacagaagtattcattcctgcagaacccccagacctcccttagggtttccttgtcttcataagtaaggacgtcttgggggtctggagggactgtttctcagagtctattccgacaccctccaacagggaggaaacacaacgacaaagagtctcagataaggctgtgggaggttgtccctcctttgtgttgagaaatccaacctagagctgctccgcatctccctgctgctcatccagtcgtctttaggttggatctcgacgaggcgtagagggacgacgagtaggtcagctggctggagcccgtgcagttcctcaggagtgtcttcgccaacagcctggtaccgacctcgggcacgtcaaggagtcctcacagaagcggttgtcggaccagtacggcgcctctgacagcaacgtctatgacctcctaaaggacctagaggcatgccgcggagactgtcgttgcagatactggaggatttcctggatctccaaggcatccaaacgctgatggggaggctggaagatggcagcccccggactttccgtaggtttgcgactacccctccgaccttctaccgtcgggggcctgagggcagatcttcaagcagacctacagcaagttcgacacaaactcacacaacccgtctagaagttcgtctggatgtcgttcaagctgtgtttgagtgtgttcgatgacgcactactcaagaactacgggctgctctactgcttcaggaagggctactgcgtgatgagttcttgatgcccgacgagatgacgaagtccttccacatggacaaggtcgagacattcctgcgcatcgtgcagtgccgctctgtgtgtacctgttccagctctgtaaggacgcgtagcacgtcacggcgagacacgagggcagctgtggcttctaaggatccgaattcgagctccgtcgacaagcctcccgtcgacaccgaagattcctaggcttaagctcgaggcagctgttcgttgcggccgcactcgatgagcaataactagcataaccccttggggcctctaacgccggcgtgagctactcgttattgatcgtattggggaaccccggagaaaacgggtcttgaggggttttttgctgaaaggaggaatttgcccagaactccccaaaaaacgactttcctcctt

What is claimed is:

1. A modified growth hormone polypeptide, or an active portion thereof, comprising an amino acid replacement of Y with I in an unmodified growth hormone polypeptide at a locus corresponding to amino acid Y42 of a mature growth hormone polypeptide set forth in SEQ ID NO:1, wherein the amino acid replacement is the only amino acid replacement in the polypeptide, wherein:

the active portion thereof includes the position corresponding to Y42.

2. The modified growth hormone polypeptide of claim 1 that includes a signal sequence.

3. The modified growth hormone polypeptide of claim 1 that is a mature polypeptide lacking the signal sequence.

4. The modified growth hormone polypeptide of claim 1, wherein the amino acid replacement is in an unmodified growth hormone that is a pituitary growth hormone comprising a sequence of amino acids set forth in SEQ ID NO:1 or SEQ ID NO:713, allelic or species variants, alternative splice variants, or an active portion thereof that includes the position corresponding to Y42.

5. The modified growth hormone polypeptide of claim 1, wherein the amino acid replacement is made in an unmodified growth hormone that is a placental growth hormone.

6. The modified growth hormone of claim 5, wherein the unmodified placental growth hormone comprises a sequence of amino acids set forth in SEQ ID NO:712, or a mature form thereof, allelic or species variants, alternative splice variants, or an active portion thereof that includes the position corresponding to Y42.

7. The modified growth hormone of claim 1, comprising the sequence of amino acids set forth in SEQ ID NO: 59, or an active portion thereof that includes I at position 42.

8. A pharmaceutical composition, comprising the modified growth hormone polypeptide of claim 1.

9. The pharmaceutical composition of claim 8, wherein the pharmaceutical composition is formulated for oral administration.

10. A method, comprising orally administering the pharmaceutical composition of claim 9 to a subject, wherein the subject has a disease or condition that is treated by the administration of a growth hormone.

11. The method of claim 10, wherein the disease or condition is selected from among a growth deficiency disorder, AIDS wasting, aging, impaired immune function of HIV-infected subjects, a catabolic illness, surgical recovery, a congestive cardiomyopathy, liver transplantation, liver regeneration after hepatectomy, chronic renal failure, renal osteodystrophy, osteoporosis, achondroplasia/hypochondroplasia, skeletal dysplasia, a chronic inflammatory or nutritional disorder such as Crohn's disease, short bowel syndrome, juvenile chronic arthritis, cystic fibrosis, male infertility, X-linked hypophosphatemic rickets, Down's syndrome, Spina bifida, Noonan Syndrome, obesity, impaired muscle strength and fibromyalgia.

12. The method of claim 11, wherein the growth deficiency disorder is selected from among Turner's syndrome, intrauterine growth retardation, idiopathic short stature, Prader Willi syndrome, and thalassaemia.

13. The pharmaceutical composition of claim 9 that is formulated as a tablet or capsule.

14. A method, comprising administering the pharmaceutical composition of claim 8 to a subject, wherein the subject has a disease or condition that is treated by the administration of a growth hormone.

15. The method of claim 14, wherein the disease or condition is selected from among a growth deficiency disorder, AIDS wasting, aging, impaired immune function of HIV-infected subjects, a catabolic illness, surgical recovery, a congestive cardiomyopathy, liver transplantation, liver regeneration after hepatectomy, chronic renal failure, renal osteodystrophy, osteoporosis, achondroplasia/hypochondroplasia, skeletal dysplasia, a chronic inflammatory or nutritional disorder such as Crohn's disease, short bowel syndrome, juvenile chronic arthritis, cystic fibrosis, male infertility, X-linked hypophosphatemic rickets, Down's syndrome, Spina bifida, Noonan Syndrome, obesity, impaired muscle strength and fibromyalgia.

16. The method of claim 15, wherein the growth deficiency disorder is selected from among Turner's syndrome, intrauterine growth retardation, idiopathic short stature, Prader Willi syndrome, and thalassaemia.

17. A modified growth hormone polypeptide, comprising:

an amino acid replacement of Y with I in an unmodified growth hormone polypeptide at a locus corresponding to amino acid Y42 of a mature growth hormone polypeptide set forth in SEQ ID NO:1; and only one to five further amino acid replacements at positions corresponding to F1, P2, P5, R8, L9, F10, D11, M14, R16, R19, L23, F25, D26, E30, E32, E33, P37, K38, E39, K41, L52, F54, L73, E74, R77, L80, L81, L82, W86, L87, P89, L93, F97, Y103, D107, Y111, D112, L113, L114, K115, D116, L117, E118, E119, L124, M125, R127, L128, F139, D153, D154, L156, L157, K158, L162, L163, F166, R167, K168, D169, M170, D171, K172, E174, L177, R178, F191, L6, L9, A13, L15, A17, L20, L23, A24, A105, V110, L113, L114, L117, I121, L124, L128, E56, E65, E66, E88, R94, L101, E129, P133, R134, K140, Y143, K145, D147, R183 and E186, wherein:

the amino acid replacements are selected from among F1V, P2A, P5A, P5S, R8H, L9I, L9V, D11N, D11Q, M14V, R16H, R19H, L23I, L23V, F25I, F25V, D26N, D26Q, E30H, E30N, E32Q, E32H, E32N, E33Q, E33H, E33N, P37S, K38N, K38Q, E39H, K41Q, L52I, L52V, F54V, L73I, L73V, E74N, R77Q, L80V, L81V, L82V, W86H, L87V, P89A, L93I, F97V, Y103H, Y103I, D107N, D107Q, Y111H, Y111I, D112N, D112Q, L113I, L113V, L114I, K115Q, D116N, D116Q, E118N, E119Q, E119H, L124V, M125I, M125V, R127H, R127Q, L128V, F139I, D153N, D154N, D154Q, L156I, L157I, L157V, K158N, L162I, L163V, F166I, F166V, R167H, R167Q, K168N, K168Q, D169N, D169Q, M170I, M170V, D171N, D171Q, K172N, K172Q, E174Q, E174H, E174N, L177I, L177V, R178H, R178Q, F191I, F191V, L6E, L6D, L6K, L6R, L6N, L6Q, L6S, L6T, L9E, L9D, L9K, L9R, L9N, L9Q, L9S, L9T, A13E, A13D, A13K, A13R, A13N, A13Q, A13S, A13T, L15E, L15D, L15K, L15R, L15Q, L15N, L15S, L15T, A17E, A17D, A17K, A17R, A17N, A17Q, A17S, A17T, L20E, L20D, L20K, L20R, L20N, L20Q, L20S, L20T, L23E, L23D, L23K, L23R, L23N, L23Q, L23S, L23T, A24E, A24D, A24K, A24R, A24N, A24Q, A24S, A24T, A105E, A105D, A105K, A105R, A105N, A105Q, A105S, A105T, V110E, V110D, V110K, V110R, V110N, V110Q, V110S, V110T, L113E, L113D, L113K, L113R, L113N, L113Q, L113S, L113T, L114E, L114D, L114K, L114R, L114N, L114Q, L114S, L114T, L117E, L117D, L117K, L117R, L117Q, L117S, L117T, I121E, I121D, I121K, I121R, I121N, I121Q, I121S, I121T, L124E, L124D, L124K, L124R, L124N, L124Q, L124S, L124T, L128E, L128D, L128K, L128R, L128Q, L128N, L128S, L128T, E56Q, E56N, E65Q, E66Q, E66H, E88Q, R94H, L101V, L101I, E129N, P133A, R134H, R134Q, K140Q, K140N, Y143H, Y143I, K145N, D147Q, D147N, R183Q, E186Q, and E186H of a mature human growth hormone polypeptide set forth in SEQ ID NO:1;

the modified growth hormone polypeptide contains only 2 to 6 amino acid replacements;

the modified growth hormone polypeptide retains an activity of the unmodified polypeptide; and the modified growth hormone polypeptide is more resistant to proteolysis to proteases in serum or the gastrointestinal tract than the unmodified polypeptide.

18. The modified growth hormone polypeptide of claim 17 that includes a signal sequence.

19. The modified growth hormone polypeptide of claim 17 that is a mature polypeptide lacking the signal sequence.

20. The modified growth hormone polypeptide of claim 17, wherein the amino acid replacements are in an unmodified growth hormone that is a pituitary growth hormone comprising a sequence of amino acids set forth in SEQ ID NO:1 or SEQ ID NO:713, allelic or species variants, alternative splice variants, or an active portion thereof that includes the amino acid replacements.

21. The modified growth hormone polypeptide of claim 17, wherein the amino acid replacement is made in an unmodified growth hormone that is a placental growth hormone.

22. The modified growth hormone of claim 21, wherein the unmodified placental growth hormone comprises a sequence of amino acids set forth in SEQ ID NO:712, or a mature form thereof, allelic or species variants, alternative splice variants, or an active portion thereof that includes the amino acid replacements.

23. A pharmaceutical composition, comprising the modified growth hormone polypeptide of claim 17.

24. The pharmaceutical composition of claim 23, wherein the pharmaceutical composition is formulated for oral administration.

25. The pharmaceutical composition of claim 24 that is formulated as a tablet or capsule.

26. A method, comprising orally administering the pharmaceutical composition of claim 24 to a subject, wherein the subject has a disease or condition that is treated by the administration of a growth hormone.

27. The method of claim 26, wherein the disease or condition is selected from among a growth deficiency disorder, AIDS wasting, aging, impaired immune function of HIV-infected subjects, a catabolic illness, surgical recovery, a congestive cardiomyopathy, liver transplantation, liver regeneration after hepatectomy, chronic renal failure, renal osteodystrophy, osteoporosis, achondroplasia/hypochondroplasia, skeletal dysplasia, a chronic inflammatory or nutritional disorder such as Crohn's disease, short bowel syndrome, juvenile chronic arthritis, cystic fibrosis, male infertility, X-linked hypophosphatemic rickets, Down's syndrome, Spina bifida, Noonan Syndrome, obesity, impaired muscle strength and fibromyalgia.

28. The method of claim 27, wherein the growth deficiency disorder is selected from among Turner's syndrome, intrauterine growth retardation, idiopathic short stature, Prader Willi syndrome, and thalassaemia.

29. A method, comprising administering the pharmaceutical composition of claim 23 to a subject, wherein the subject has a disease or condition that is treated by the administration of a growth hormone.

30. The method of claim 29, wherein the disease or condition is selected from among a growth deficiency disorder, AIDS wasting, aging, impaired immune function of HIV-infected subjects, a catabolic illness, surgical recovery, a congestive cardiomyopathy, liver transplantation, liver regeneration after hepatectomy, chronic renal failure, renal osteodystrophy, osteoporosis, achondroplasia/hypochondroplasia, skeletal dysplasia, a chronic inflammatory or nutritional disorder such as Crohn's disease, short bowel syndrome, juvenile chronic arthritis, cystic fibrosis, male infertility, X-linked hypophosphatemic rickets, Down's syndrome, Spina bifida, Noonan Syndrome, obesity, impaired muscle strength and fibromyalgia.

31. The method of claim 30, wherein the growth deficiency disorder is selected from among Turner's syndrome, intrauterine growth retardation, idiopathic short stature, Prader Willi syndrome, and thalassaemia.

32. The method of claim 29, wherein the composition is formulated as a tablet or capsule.

* * * * *

UNITED STATES PATENT AND TRADEMARK OFFICE
CERTIFICATE OF CORRECTION

| | | |
|---|---|---|
| PATENT NO. | : 7,884,073 B2 | Page 1 of 2 |
| APPLICATION NO. | : 11/476173 | |
| DATED | : February 8, 2011 | |
| INVENTOR(S) | : Guyon et al. | |

It is certified that error appears in the above-identified patent and that said Letters Patent is hereby corrected as shown below:

IN THE TITLE PAGES:
In Item (54), please replace "MODIFIED GROWTH HORMONE" with
--MODIFIED GROWTH HORMONES--;
In Item (56) References Cited, U.S. PATENT DOCUMENTS, please replace
"2002/0008158 A1 1/2002 Kuzuyama" with --2002/0081574 A1 Collett et al.--;

IN THE CLAIMS:
Column 82, line 65, to Column 83, line 60, should read
17.    A modified growth hormone polypeptide, comprising:
an amino acid replacement of Y with I in an unmodified growth hormone polypeptide at a locus corresponding to amino acid Y42 of a mature growth hormone polypeptide set forth in SEQ ID NO:1; and
only one to five further amino acid replacements at positions corresponding to F1, P2, P5, R8, L9, F10, D11, M14, R16, R19, L23, F25, D26, E30, E32, E33, P37, K38, E39, K41, L52, F54, L73, E74, R77, L80, L81, L82, W86, L87, P89, L93, F97, Y103, D107, Y111, D112, L113, L114, K115, D116, L117, E118, E119, L124, M125, R127, L128, F139, D153, D154, L156, L157, K158, L162, L163, F166, R167, K168, D169, M170, D171, K172, E174, L177, R178, F191, L6, L9, A13, L15, A17, L20, L23, A24, A105, V110, L113, L114, L117, I121, L124, L128, E56, E65, E66, E88, R94, L101, E129, P133, R134, K140, Y143, K145, D147, R183 and E186, wherein:
the amino acid replacements are selected from among F1V, P2A, P5A, P5S, R8H, L9I, L9V, D11N, D11Q, M14V, R16H, R19H, L23I, L23V, F25I, F25V, D26N, D26Q, E30H, E30N, E32Q, E32H, E32N, E33Q, E33H, E33N, P37S, K38N, K38Q, E39H, K41Q, L52I, L52V, F54V, L73I, L73V, E74N, R77Q, L80V, L81V, L82V, W86H, L87V, P89A, L93I, F97V, Y103H, Y103I, D107N, D107Q, Y111H, Y111I, D112N, D112Q, L113I, L113V, L114I, K115Q, D116N, D116Q, E118N, E119Q, E119H, L124V, M125I, M125V, R127H, R127Q, L128V, F139I, D153N, D154N, D154Q, L156I, L157I, L157V, K158N, L162I, L163V, F166I, F166V, R167H, R167Q, K168N, K168Q, D169N, D169Q, M170I, M170V, D171N, D171Q, K172N, K172Q, E174Q, E174H, E174N, L177I, L177V, R178H, R178Q, F191I, F191V, L6E, Signed and Sealed this
Twentieth Day of March, 2012

David J. Kappos
*Director of the United States Patent and Trademark Office*

CERTIFICATE OF CORRECTION (continued)
U.S. Pat. No. 7,884,073 B2

L6D, L6K, L6R, L6N, L6Q, L6S, L6T, L9E, L9D, L9K, L9R, L9N, L9Q, L9S, L9T, A13E, A13D, A13K, A13R, A13N, A13Q, A13S, A13T, L15E, L15D, L15K, L15R, L15Q, L15N, L15S, L15T, A17E, A17D, A17K, A17R, A17N, A17Q, A17S, A17T, L20E, L20D, L20K, L20R, L20N, L20Q, L20S, L20T, L23E, L23D, L23K, L23R, L23N, L23Q, L23S, L23T, A24E, A24D, A24K, A24R, A24N, A24Q, A24S, A24T, A105E, A105D, A105K, A105R, A105N, A105Q, A105S, A105T, V110E, V110D, V110K, V110R, V110N, V110Q, V110S, V110T, L113E, L113D, L113K, L113R, L113N, L113Q, L113S, L113T, L114E, L114D, L114K, L114R, L114N, L114Q, L114S, L114T, L117E, L117D, L117K, L117R, L117N, L117Q, L117S, L117T, I121E, I121D, I121K, I121R, I121N, I121Q, I121S, I121T, L124E, L124D, L124K, L124R, L124N, L124Q, L124S, L124T, L128E, L128D, L128K, L128R, L128Q, L128N, L128S, L128T, E56Q, E56N, E65Q, E66Q, E66H, E88Q, R94H, L101V, L101I, E129N, P133A, R134H, R134Q, K140Q, K140N, Y143H, Y143I, K145N, D147Q, D147N, R183Q, E186Q, and E186H of a mature human growth hormone polypeptide set forth in SEQ ID NO:1;

the modified growth hormone polypeptide contains only 2 to 6 amino acid replacements;
    the modified growth hormone polypeptide retains an activity of the unmodified polypeptide: and
    the modified growth hormone polypeptide is more resistant to proteolysis to proteases in serum or the gastrointestinal tract than the unmodified polypeptide.